United States Patent 12,508,308 (INFLUENZA mRNA VACCINES) - sequence listing, part 18

SEQ ID NO: 64808 - RNA, 1701 nt, Artificial Sequence
  derived and/or modified sequence opt1 from hemagglutinin__InfluenzaA__ACZ81652
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccgaggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgcuacagcaagaaguucaagcccgagaucgccauccggccgaagguccgcggccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 64809 - RNA, 1701 nt, Artificial Sequence
  derived and/or modified sequence opt1 from hemagglutinin__InfluenzaA__ACZ92130
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaucgaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64810 - RNA, 1701 nt, Artificial Sequence; identical to SEQ ID NO: 63919
  derived and/or modified sequence opt1 from hemagglutinin__InfluenzaA__ACZ92131

SEQ ID NO: 64811 - RNA, 1701 nt, Artificial Sequence; identical to SEQ ID NO: 63919
  derived and/or modified sequence opt1 from hemagglutinin__InfluenzaA__ACZ92132

SEQ ID NO: 64812 - RNA, 1701 nt, Artificial Sequence; identical to SEQ ID NO: 63919
  derived and/or modified sequence opt1 from hemagglutinin__InfluenzaA__ACZ92133

SEQ ID NO: 64813 - RNA, 1701 nt, Artificial Sequence; identical to SEQ ID NO: 63677
  derived and/or modified sequence opt1 from hemagglutinin__InfluenzaA__ACZ92134

SEQ ID NO: 64814 - RNA, 1701 nt, Artificial Sequence; identical to SEQ ID NO: 63677
  derived and/or modified sequence opt1 from hemagglutinin__InfluenzaA__ACZ95465

SEQ ID NO: 64815 - RNA, 1701 nt, Artificial Sequence; identical to SEQ ID NO: 63664
  derived and/or modified sequence opt1 from hemagglutinin__InfluenzaA__ACZ95837

SEQ ID NO: 64816 - RNA, 1701 nt, Artificial Sequence; identical to SEQ ID NO: 63677
  derived and/or modified sequence opt1 from hemagglutinin__InfluenzaA__ACZ95847

SEQ ID NO: 64817 - RNA, 1701 nt, Artificial Sequence
  derived and/or modified sequence opt1 from hemagglutinin__InfluenzaA__ACZ95857
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccuccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64818 - RNA, 1701 nt, Artificial Sequence; identical to SEQ ID NO: 63677
  derived and/or modified sequence opt1 from hemagglutinin__InfluenzaA__ACZ95867

SEQ ID NO: 64819 - RNA, 1701 nt, Artificial Sequence
  derived and/or modified sequence opt1 from hemagglutinin__InfluenzaA__ACZ95887
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccggaaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64820 - RNA, 1701 nt, Artificial Sequence; identical to SEQ ID NO: 63677
  derived and/or modified sequence opt1 from hemagglutinin__InfluenzaA__ACZ95897

SEQ ID NO: 64821 - RNA, 1701 nt, Artificial Sequence
  derived and/or modified sequence opt1 from hemagglutinin__InfluenzaA__ACZ95907
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccguguacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64822 - RNA, 1701 nt, Artificial Sequence; identical to SEQ ID NO: 63677
  derived and/or modified sequence opt1 from hemagglutinin__InfluenzaA__ACZ95927

SEQ ID NO: 64823 - RNA, 1701 nt, Artificial Sequence
  derived and/or modified sequence opt1 from hemagglutinin__InfluenzaA__ACZ95937
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaacgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64824 - RNA, 1701 nt, Artificial Sequence; identical to SEQ ID NO: 63919
  derived and/or modified sequence opt1 from hemagglutinin__InfluenzaA__ACZ95947

SEQ ID NO: 64825 - RNA, 1701 nt, Artificial Sequence; identical to SEQ ID NO: 63677
  derived and/or modified sequence opt1 from hemagglutinin__InfluenzaA__ACZ95957

SEQ ID NO: 64826 - RNA, 1701 nt, Artificial Sequence; identical to SEQ ID NO: 63919
  derived and/or modified sequence opt1 from hemagglutinin__InfluenzaA__ACZ95967

SEQ ID NO: 64827 - RNA, 1701 nt, Artificial Sequence; identical to SEQ ID NO: 64823
  derived and/or modified sequence opt1 from hemagglutinin__InfluenzaA__ACZ95977

SEQ ID NO: 64828 - RNA, 1701 nt, Artificial Sequence
  derived and/or modified sequence opt1 from hemagglutinin__InfluenzaA__ACZ95987
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugaucgacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 64829 - RNA, 1701 nt, Artificial Sequence; identical to SEQ ID NO: 63677
  derived and/or modified sequence opt1 from hemagglutinin__InfluenzaA__ACZ95997

SEQ ID NO: 64830 - RNA, 1701 nt, Artificial Sequence; identical to SEQ ID NO: 63677
  derived and/or modified sequence opt1 from hemagglutinin__InfluenzaA__ACZ96007

SEQ ID NO: 64831 - RNA, 1701 nt, Artificial Sequence; identical to SEQ ID NO: 63664
  derived and/or modified sequence opt1 from hemagglutinin__InfluenzaA__ACZ96017

SEQ ID NO: 64832 - RNA, 1701 nt, Artificial Sequence; identical to SEQ ID NO: 63677
  derived and/or modified sequence opt1 from hemagglutinin__InfluenzaA__ACZ96027

SEQ ID NO: 64833 - RNA, 1701 nt, Artificial Sequence; identical to SEQ ID NO: 64823
  derived and/or modified sequence opt1 from hemagglutinin__InfluenzaA__ACZ96047

SEQ ID NO: 64834 - RNA, 1701 nt, Artificial Sequence
  derived and/or modified sequence opt1 from hemagglutinin__InfluenzaA__ACZ96057
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacagcuacccgaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacauccccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 64835 - RNA, 1701 nt, Artificial Sequence
  derived and/or modified sequence opt1 from hemagglutinin__InfluenzaA__ACZ96069
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccgggaacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64836 - RNA, 1701 nt, Artificial Sequence; identical to SEQ ID NO: 64823
  derived and/or modified sequence opt1 from hemagglutinin__InfluenzaA__ACZ96089

SEQ ID NO: 64837 - RNA, 1701 nt, Artificial Sequence
  derived and/or modified sequence opt1 from hemagglutinin__InfluenzaA__ACZ96119
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64838 - RNA, 1701 nt, Artificial Sequence
  derived and/or modified sequence opt1 from hemagglutinin__InfluenzaA__ACZ96129
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgaguucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64839 - RNA, 1701 nt, Artificial Sequence; identical to SEQ ID NO: 63677
  derived and/or modified sequence opt1 from hemagglutinin__InfluenzaA__ACZ96149

SEQ ID NO: 64840 - RNA, 1701 nt, Artificial Sequence; identical to SEQ ID NO: 63677
  derived and/or modified sequence opt1 from hemagglutinin__InfluenzaA__ACZ96159

SEQ ID NO: 64841 - RNA, 1701 nt, Artificial Sequence
  derived and/or modified sequence opt1 from hemagglutinin__InfluenzaA__ACZ96179
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64842 - RNA, 1701 nt, Artificial Sequence; identical to SEQ ID NO: 64834
  derived and/or modified sequence opt1 from hemagglutinin__InfluenzaA__ACZ96189

SEQ ID NO: 64843 - RNA, 1701 nt, Artificial Sequence; identical to SEQ ID NO: 64841
  derived and/or modified sequence opt1 from hemagglutinin__InfluenzaA__ACZ96199

SEQ ID NO: 64844 - RNA, 1701 nt, Artificial Sequence; identical to SEQ ID NO: 63677
  derived and/or modified sequence opt1 from hemagglutinin__InfluenzaA__ACZ96209

SEQ ID NO: 64845 - RNA, 1701 nt, Artificial Sequence
  derived and/or modified sequence opt1 from hemagglutinin__InfluenzaA__ACZ96219
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaaguucgaggcgaccggcaaccucguggucccccgguacgccuucgccauggagcgcaacgccggguccggcaucaucaucagcgacacccccgugcacgacugcaacacgaccugccagaccuccaagggcgccaucaacaccagccugccguuccagaacauccaccccaucacgaucgggaagugccccaaguacgugaaguccaccaagcugcggcucgcgaccggccugcgcaacguccccagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgcgggcgugaagcucgaguccacccgcaucuaccagauccuggccaucuacagcaccgucgccagcucccuggugcucguggucagccugggggccaucuccuucuggaugugcagcaacggcucccugcagugccggaucugcaucuga

SEQ ID NO: 64846 - RNA, 1701 nt, Artificial Sequence; identical to SEQ ID NO: 63677
  derived and/or modified sequence opt1 from hemagglutinin__InfluenzaA__ACZ96229

SEQ ID NO: 64847 - RNA, 1701 nt, Artificial Sequence; identical to SEQ ID NO: 64841
  derived and/or modified sequence opt1 from hemagglutinin__InfluenzaA__ACZ96239

SEQ ID NO: 64848 - RNA, 1701 nt, Artificial Sequence; identical to SEQ ID NO: 63677
  derived and/or modified sequence opt1 from hemagglutinin__InfluenzaA__ACZ96249

SEQ ID NO: 64849 - RNA, 1701 nt, Artificial Sequence
  derived and/or modified sequence opt1 from hemagglutinin__InfluenzaA__ACZ96269
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 64850 - RNA, 1701 nt, Artificial Sequence; identical to SEQ ID NO: 63677
  derived and/or modified sequence opt1 from hemagglutinin__InfluenzaA__ACZ96299

SEQ ID NO: 64851 - RNA, 1701 nt, Artificial Sequence; identical to SEQ ID NO: 63677
  derived and/or modified sequence opt1 from hemagglutinin__InfluenzaA__ACZ96309

SEQ ID NO: 64852 - RNA, 1701 nt, Artificial Sequence
  derived and/or modified sequence opt1 from hemagglutinin__InfluenzaA__ACZ96319
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaucugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64853 - RNA, 1701 nt, Artificial Sequence; identical to SEQ ID NO: 64852
  derived and/or modified sequence opt1 from hemagglutinin__InfluenzaA__ACZ96329

SEQ ID NO: 64854 - RNA, 1701 nt, Artificial Sequence
  derived and/or modified sequence opt1 from hemagglutinin__InfluenzaA__ACZ96339
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucaagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64855 - RNA, 1701 nt, Artificial Sequence; identical to SEQ ID NO: 63677
  derived and/or modified sequence opt1 from hemagglutinin__InfluenzaA__ACZ96349

SEQ ID NO: 64856 - RNA, 1701 nt, Artificial Sequence; identical to SEQ ID NO: 64852
  derived and/or modified sequence opt1 from hemagglutinin__InfluenzaA__ACZ96359

SEQ ID NO: 64857 - RNA, 1701 nt, Artificial Sequence; identical to SEQ ID NO: 63677
  derived and/or modified sequence opt1 from hemagglutinin__InfluenzaA__ACZ96372

SEQ ID NO: 64858 - RNA, 1701 nt, Artificial Sequence; identical to SEQ ID NO: 64852
  derived and/or modified sequence opt1 from hemagglutinin__InfluenzaA__ACZ96382

SEQ ID NO: 64859 - RNA, 1701 nt, Artificial Sequence; identical to SEQ ID NO: 63664
  derived and/or modified sequence opt1 from hemagglutinin__InfluenzaA__ACZ96392

SEQ ID NO: 64860 - RNA, 1701 nt, Artificial Sequence; identical to SEQ ID NO: 63919
  derived and/or modified sequence opt1 from hemagglutinin__InfluenzaA__ACZ96405

SEQ ID NO: 64861 - RNA, 1701 nt, Artificial Sequence; identical to SEQ ID NO: 63677
  derived and/or modified sequence opt1 from hemagglutinin__InfluenzaA__ACZ96415

SEQ ID NO: 64862 - RNA, 1701 nt, Artificial Sequence; identical to SEQ ID NO: 63677
  derived and/or modified sequence opt1 from hemagglutinin__InfluenzaA__ACZ96425

SEQ ID NO: 64863 - RNA, 1701 nt, Artificial Sequence
  derived and/or modified sequence opt1 from hemagglutinin__InfluenzaA__ACZ96435
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcccagcugcaccucgggaagugcaacaucgccggcuggauccuggggaaccccgagugcgagagccuguccaccgcgagcuccuggagcuacaucguggagaccuccagcuccgacaacggcacgugcuacccgggcgacuucaucgacuacgaggagcuccgggagcagcugagcuccgugagcuccuucgagcgcuucgagaucuuccccaagaccagcuccuggcccaaccacgacagcaacaagggggucaccgccgccugcccccacgccggcgcgaaguccuucuacaagaaccugaucuggcucgugaagaaggggaacagcuacccgaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccugguggagccgggggacaagaucaccuucgaggcgaccggcaaccucauggugccccgguacgccuucgccauggagcgcaacgccggguccggcaucaucaucagcgacacgcccguccacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 64864 - RNA, 1701 nt, Artificial Sequence; identical to SEQ ID NO: 63677
  derived and/or modified sequence opt1 from hemagglutinin__InfluenzaA__ACZ96445

SEQ ID NO: 64865 - RNA, 1701 nt, Artificial Sequence
  derived and/or modified sequence opt1 from hemagglutinin__InfluenzaA__ACZ96476
augaaggccauccuggugguccuccuguacaccuucgccaccgcguacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64866 - RNA, 1701 nt, Artificial Sequence; identical to SEQ ID NO: 63677
  derived and/or modified sequence opt1 from hemagglutinin__InfluenzaA__ACZ96496

SEQ ID NO: 64867 - RNA, 1701 nt, Artificial Sequence; identical to SEQ ID NO: 63677
  derived and/or modified sequence opt1 from hemagglutinin__InfluenzaA__ACZ96506

SEQ ID NO: 64868 - RNA, 1701 nt, Artificial Sequence; identical to SEQ ID NO: 63677
  derived and/or modified sequence opt1 from hemagglutinin__InfluenzaA__ACZ96526

SEQ ID NO: 64869 - RNA, 1701 nt, Artificial Sequence
  derived and/or modified sequence opt1 from hemagglutinin__InfluenzaA__ACZ96536
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgcgagcagcucagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacacguacguguucgugggcuccagcaaguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccagccuccccuuccagaacauccaccccaucaccaucgggaagugccccaagcacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcaacggcucccugcagugccggaucugcaucuga

SEQ ID NO: 64870 - RNA, 1701 nt, Artificial Sequence; identical to SEQ ID NO: 63677
  derived and/or modified sequence opt1 from hemagglutinin__InfluenzaA__ACZ96549

SEQ ID NO: 64871 - RNA, 1701 nt, Artificial Sequence
  derived and/or modified sequence opt1 from hemagglutinin__InfluenzaA__ACZ96559
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64872 - RNA, 1701 nt, Artificial Sequence
  derived and/or modified sequence opt1 from hemagglutinin__InfluenzaA__ACZ96569
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64873 - RNA, 1701 nt, Artificial Sequence
  derived and/or modified sequence opt1 from hemagglutinin__InfluenzaA__ACZ96579
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcuccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucgccauggagcgcaacgccggguccggcaucaucaucagcgacacccccgugcacgacugcaacaccacgugccagaccccgaagggcgccaucaacaccucccugcccuuccacaacauccaccccaucaccaucgggaagugccccaaguacgucaagagcacgaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 64874 - RNA, 1701 nt, Artificial Sequence; identical to SEQ ID NO: 63677
  derived and/or modified sequence opt1 from hemagglutinin__InfluenzaA__ACZ96589

SEQ ID NO: 64875 - RNA, 1701 nt, Artificial Sequence
  derived and/or modified sequence opt1 from hemagglutinin__InfluenzaA__ACZ96599
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacacgggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64876 - RNA, 1701 nt, Artificial Sequence
  derived and/or modified sequence opt1 from hemagglutinin__InfluenzaA__ACZ96609
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaccugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64877 - RNA, 1701 nt, Artificial Sequence; identical to SEQ ID NO: 63857
  derived and/or modified sequence opt1 from hemagglutinin__InfluenzaA__ACZ96619

SEQ ID NO: 64878 - RNA, 1701 nt, Artificial Sequence; identical to SEQ ID NO: 63857
  derived and/or modified sequence opt1 from hemagglutinin__InfluenzaA__ACZ96629

SEQ ID NO: 64879 - RNA, 1701 nt, Artificial Sequence; identical to SEQ ID NO: 63857
  derived and/or modified sequence opt1 from hemagglutinin__InfluenzaA__ACZ96639

SEQ ID NO: 64880 - RNA, 1701 nt, Artificial Sequence; identical to SEQ ID NO: 63857
  derived and/or modified sequence opt1 from hemagglutinin__InfluenzaA__ACZ96649

SEQ ID NO: 64881 - RNA, 1701 nt, Artificial Sequence; identical to SEQ ID NO: 63857
  derived and/or modified sequence opt1 from hemagglutinin__InfluenzaA__ACZ96659

SEQ ID NO: 64882 - RNA, 1701 nt, Artificial Sequence; identical to SEQ ID NO: 63857
  derived and/or modified sequence opt1 from hemagglutinin__InfluenzaA__ACZ96669

SEQ ID NO: 64883 - RNA, 1701 nt, Artificial Sequence; identical to SEQ ID NO: 63857
  derived and/or modified sequence opt1 from hemagglutinin__InfluenzaA__ACZ96679

SEQ ID NO: 64884 - RNA, 1701 nt, Artificial Sequence; identical to SEQ ID NO: 63857
  derived and/or modified sequence opt1 from hemagglutinin__InfluenzaA__ACZ96689

SEQ ID NO: 64885 - RNA, 1701 nt, Artificial Sequence; identical to SEQ ID NO: 63857
  derived and/or modified sequence opt1 from hemagglutinin__InfluenzaA__ACZ96699

SEQ ID NO: 64886 - RNA, 1701 nt, Artificial Sequence; identical to SEQ ID NO: 63857
  derived and/or modified sequence opt1 from hemagglutinin__InfluenzaA__ACZ96719

SEQ ID NO: 64887 - RNA, 1701 nt, Artificial Sequence; identical to SEQ ID NO: 63857
  derived and/or modified sequence opt1 from hemagglutinin__InfluenzaA__ACZ96729

SEQ ID NO: 64888 - RNA, 1701 nt, Artificial Sequence; identical to SEQ ID NO: 63857
  derived and/or modified sequence opt1 from hemagglutinin__InfluenzaA__ACZ96739

SEQ ID NO: 64889 - RNA, 1701 nt, Artificial Sequence
  derived and/or modified sequence opt1 from hemagglutinin__InfluenzaA__ACZ96749
augaagaccauccuggugguccuccuguacaccuucgccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64890 - RNA, 1701 nt, Artificial Sequence; identical to SEQ ID NO: 63664
  derived and/or modified sequence opt1 from hemagglutinin__InfluenzaA__ACZ96759

SEQ ID NO: 64891 - RNA, 1701 nt, Artificial Sequence; identical to SEQ ID NO: 63664
  derived and/or modified sequence opt1 from hemagglutinin__InfluenzaA__ACZ96769

SEQ ID NO: 64892 - RNA, 1701 nt, Artificial Sequence; identical to SEQ ID NO: 63664
  derived and/or modified sequence opt1 from hemagglutinin__InfluenzaA__ACZ96779

SEQ ID NO: 64893 - RNA, 1701 nt, Artificial Sequence; identical to SEQ ID NO: 63664
  derived and/or modified sequence opt1 from hemagglutinin__InfluenzaA__ACZ96789

SEQ ID NO: 64894 - RNA, 1701 nt, Artificial Sequence
  derived and/or modified sequence opt1 from hemagglutinin__InfluenzaA__ACZ96809
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaacgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucgccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacagcaccgucgccuccagccuggugcucguggucagccugggggccaucuccuucuggaugugcagcaacggcucccugcagugccggaucugcaucuga

SEQ ID NO: 64895 - RNA, 1701 nt, Artificial Sequence; identical to SEQ ID NO: 63664
  derived and/or modified sequence opt1 from hemagglutinin__InfluenzaA__ACZ96819

SEQ ID NO: 64896 - RNA, 1701 nt, Artificial Sequence; identical to SEQ ID NO: 63664
  derived and/or modified sequence opt1 from hemagglutinin__InfluenzaA__ACZ96829

SEQ ID NO: 64897 - RNA, 1701 nt, Artificial Sequence; identical to SEQ ID NO: 63664
  derived and/or modified sequence opt1 from hemagglutinin__InfluenzaA__ACZ96839

SEQ ID NO: 64898 - RNA, 1701 nt, Artificial Sequence; identical to SEQ ID NO: 64817
  derived and/or modified sequence opt1 from hemagglutinin__InfluenzaA__ACZ96849

SEQ ID NO: 64899 - RNA, 1701 nt, Artificial Sequence; identical to SEQ ID NO: 63677
  derived and/or modified sequence opt1 from hemagglutinin__InfluenzaA__ACZ96859

SEQ ID NO: 64900 - RNA, 1701 nt, Artificial Sequence; identical to SEQ ID NO: 63664
  derived and/or modified sequence opt1 from hemagglutinin__InfluenzaA__ACZ96869

SEQ ID NO: 64901 - RNA, 1701 nt, Artificial Sequence; identical to SEQ ID NO: 63664
  derived and/or modified sequence opt1 from hemagglutinin__InfluenzaA__ACZ96879

SEQ ID NO: 64902 - RNA, 1701 nt, Artificial Sequence
  derived and/or modified sequence opt1 from hemagglutinin__InfluenzaA__ACZ96899
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccacagcuccaccagcgccgaccagcagucccuguaccagaacgccgacgccuacguguucgugggcagcucccgguacagcaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccggguccggcaucaucaucagcgacacccccgugcacgacugcaacacgaccugccagacccccaagggcgccaucaacaccucccugccguuccagaacauccaccccaucacgaucgggaagugccccaaguacgucaagagcaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 64903 - RNA, 1701 nt, Artificial Sequence; identical to SEQ ID NO: 63664
  derived and/or modified sequence opt1 from hemagglutinin__InfluenzaA__ACZ96909

SEQ ID NO: 64904 - RNA, 1701 nt, Artificial Sequence; identical to SEQ ID NO: 63664
  derived and/or modified sequence opt1 from hemagglutinin__InfluenzaA__ACZ96919

SEQ ID NO: 64905 - RNA, 1701 nt, Artificial Sequence; identical to SEQ ID NO: 63664
  derived and/or modified sequence opt1 from hemagglutinin__InfluenzaA__ACZ96929

SEQ ID NO: 64906 - RNA, 1701 nt, Artificial Sequence; identical to SEQ ID NO: 63664
  derived and/or modified sequence opt1 from hemagglutinin__InfluenzaA__ACZ96939

SEQ ID NO: 64907 - RNA, 1701 nt, Artificial Sequence
  derived and/or modified sequence opt1 from hemagglutinin__InfluenzaA__ACZ96949
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagaugcuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 64908 - RNA, 1701 nt, Artificial Sequence; identical to SEQ ID NO: 63664
  derived and/or modified sequence opt1 from hemagglutinin__InfluenzaA__ACZ97021

SEQ ID NO: 64909 - RNA, 1701 nt, Artificial Sequence; identical to SEQ ID NO: 64031
  derived and/or modified sequence opt1 from hemagglutinin__InfluenzaA__ACZ97343

SEQ ID NO: 64910 - RNA, 1701 nt, Artificial Sequence; identical to SEQ ID NO: 64031
  derived and/or modified sequence opt1 from hemagglutinin__InfluenzaA__ACZ97353

SEQ ID NO: 64911 - RNA, 1701 nt, Artificial Sequence; identical to SEQ ID NO: 63664
  derived and/or modified sequence opt1 from hemagglutinin__InfluenzaA__ACZ97363

SEQ ID NO: 64912 - RNA, 1701 nt, Artificial Sequence
  derived and/or modified sequence opt1 from hemagglutinin__InfluenzaA__ACZ97383
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccacgagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcacgagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64913 - RNA, 1701 nt, Artificial Sequence; identical to SEQ ID NO: 63664
  derived and/or modified sequence opt1 from hemagglutinin__InfluenzaA__ACZ97393

SEQ ID NO: 64914 - RNA, 1701 nt, Artificial Sequence
  derived and/or modified sequence opt1 from hemagglutinin__InfluenzaA__ACZ98178
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacuacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 64915 - RNA, 1701 nt, Artificial Sequence; identical to SEQ ID NO: 63664
  derived and/or modified sequence opt1 from hemagglutinin__InfluenzaA__ACZ98188

SEQ ID NO: 64916 - RNA, 1701 nt, Artificial Sequence; identical to SEQ ID NO: 63857
  derived and/or modified sequence opt1 from hemagglutinin__InfluenzaA__ACZ98198

SEQ ID NO: 64917 - RNA, 1701 nt, Artificial Sequence; identical to SEQ ID NO: 63677
  derived and/or modified sequence opt1 from hemagglutinin__InfluenzaA__ACZ98208

SEQ ID NO: 64918 - RNA, 1701 nt, Artificial Sequence; identical to SEQ ID NO: 63677
  derived and/or modified sequence opt1 from hemagglutinin__InfluenzaA__ACZ98218

SEQ ID NO: 64919 - RNA, 1701 nt, Artificial Sequence; identical to SEQ ID NO: 63677
  derived and/or modified sequence opt1 from hemagglutinin__InfluenzaA__ACZ98228

SEQ ID NO: 64920 - RNA, 1701 nt, Artificial Sequence; identical to SEQ ID NO: 63677
  derived and/or modified sequence opt1 from hemagglutinin__InfluenzaA__ACZ98238

SEQ ID NO: 64921 - RNA, 1701 nt, Artificial Sequence; identical to SEQ ID NO: 64306
  derived and/or modified sequence opt1 from hemagglutinin__InfluenzaA__ACZ98248

SEQ ID NO: 64922 - RNA, 1701 nt, Artificial Sequence; identical to SEQ ID NO: 63677
  derived and/or modified sequence opt1 from hemagglutinin__InfluenzaA__ACZ98258

SEQ ID NO: 64923 - RNA, 1701 nt, Artificial Sequence; identical to SEQ ID NO: 63677
  derived and/or modified sequence opt1 from hemagglutinin__InfluenzaA__ACZ98268

SEQ ID NO: 64924 - RNA, 1701 nt, Artificial Sequence; identical to SEQ ID NO: 64817
  derived and/or modified sequence opt1 from hemagglutinin__InfluenzaA__ACZ98278

SEQ ID NO: 64925 - RNA, 1701 nt, Artificial Sequence; identical to SEQ ID NO: 64817
  derived and/or modified sequence opt1 from hemagglutinin__InfluenzaA__ACZ98288

SEQ ID NO: 64926 - RNA, 1701 nt, Artificial Sequence
  derived and/or modified sequence opt1 from hemagglutinin__InfluenzaA__ACZ98298
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacggcaucaccaacaaggugaacagcgucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacggcucccugcagugccgcaucugcaucuga

SEQ ID NO: 64927 - RNA, 1701 nt, Artificial Sequence
  derived and/or modified sequence opt1 from hemagglutinin__InfluenzaA__ACZ98318
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccacauccuggcgaucuacuccaccgucgccagcagccuggugcucguggucucccugggggccaucagcuucuggaugugcuccaacggcagccugcagugccggaucugcaucuga

SEQ ID NO: 64928 - RNA, 1701 nt, Artificial Sequence; identical to SEQ ID NO: 63919
  derived and/or modified sequence opt1 from hemagglutinin__InfluenzaA__ACZ98328

SEQ ID NO: 64929 - RNA, 1701 nt, Artificial Sequence; identical to SEQ ID NO: 63677
  derived and/or modified sequence opt1 from hemagglutinin__InfluenzaA__ACZ98338

SEQ ID NO: 64930 - RNA, 1701 nt, Artificial Sequence; identical to SEQ ID NO: 64817
  derived and/or modified sequence opt1 from hemagglutinin__InfluenzaA__ACZ98348

SEQ ID NO: 64931 - RNA, 1701 nt, Artificial Sequence; identical to SEQ ID NO: 63677
  derived and/or modified sequence opt1 from hemagglutinin__InfluenzaA__ACZ98358

SEQ ID NO: 64932 - RNA, 1701 nt, Artificial Sequence; identical to SEQ ID NO: 63677
  derived and/or modified sequence opt1 from hemagglutinin__InfluenzaA__ACZ98368

SEQ ID NO: 64933 - RNA, 1701 nt, Artificial Sequence; identical to SEQ ID NO: 63919
  derived and/or modified sequence opt1 from hemagglutinin__InfluenzaA__ACZ98388

SEQ ID NO: 64934 - RNA, 1701 nt, Artificial Sequence; identical to SEQ ID NO: 63677
  derived and/or modified sequence opt1 from hemagglutinin__InfluenzaA__ACZ98398

SEQ ID NO: 64935 - RNA, 1701 nt, Artificial Sequence; identical to SEQ ID NO: 63677
  derived and/or modified sequence opt1 from hemagglutinin__InfluenzaA__ACZ98408

SEQ ID NO: 64936 - RNA, 1701 nt, Artificial Sequence; identical to SEQ ID NO: 63857
  derived and/or modified sequence opt1 from hemagglutinin__InfluenzaA__ACZ98418

SEQ ID NO: 64937 - RNA, 1701 nt, Artificial Sequence; identical to SEQ ID NO: 63677
  derived and/or modified sequence opt1 from hemagglutinin__InfluenzaA__ACZ98428

SEQ ID NO: 64938 - RNA, 1701 nt, Artificial Sequence; identical to SEQ ID NO: 63677
  derived and/or modified sequence opt1 from hemagglutinin__InfluenzaA__ACZ98438

SEQ ID NO: 64939 - RNA, 1701 nt, Artificial Sequence; identical to SEQ ID NO: 63677
  derived and/or modified sequence opt1 from hemagglutinin__InfluenzaA__ACZ98448

SEQ ID NO: 64940 - RNA, 1701 nt, Artificial Sequence; identical to SEQ ID NO: 64817
  derived and/or modified sequence opt1 from hemagglutinin__InfluenzaA__ACZ98458

SEQ ID NO: 64941 - RNA, 1701 nt, Artificial Sequence
  derived and/or modified sequence opt1 from hemagglutinin__InfluenzaA__ACZ98546
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucaccacgggccugcgcaacguccccagcauccaguaccgggggcuguucggcgcgaucaccggguucaucgagggcggcuggaccgggaugguggacggcugguacggguaccaccaccagaacgagcagggcuccggguacgccgccgaccucaagagcacccagaacgccaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 64942 - RNA, 1701 nt, Artificial Sequence
  derived and/or modified sequence opt1 from hemagglutinin__InfluenzaA__ACZ98560
augaaggccauccgcgugguccugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccggggcgucgcgccccugcaccuggggaagugcaacaucgccggcuggauccucgggaacccggagugcgagagccuguccaccgcgagcuccuggagcuacaucguggagaccuccagcuccgacaacggcacgugcuaccccggcgacuucaucgacuacgaggagcugcgcgagcagcucagcuccgugagcuccuucgagcgguucgagaucuuccccaagaccagcuccuggcccaaccacgacccgaacaagggggucaccgccgccugcccccacgccggcgccaagagcuucuacaagaaccugaucuggcuggugaagaaggggaacuccuaccccaagcucagcaaguccuacaucaacgacaagggcaaggaggugcugguccugugggggauccaccaccccagcaccagcgccgaccagcagucccucuaccagaacgccgacgccuacguguucgugggcacgagccgcuacuccaagaaguucaagccggagaucgccauccggcccaagguccgcgaccaggagggccggaugaacuacuacuggacccugguggagcccggggacaagaucaccuucgaggcgaccggcaaccugguggucccccgcuacgccuucgccauggagcggaacgccgggagcggcaucaucaucuccgacacgccggugcacgacugcaacacgaccugccagacccccaagggcgccaucaacaccagccuccccuuccagaacauccaccccaucaccaucgggaagugcccgaaguacgugaagucccccaagcugcgccuggcgaccggcaugcggaacguccccuucauccaguaccgcggccucuucggggccaucaccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgcgaggagaucgacggcgugaagcuggaguccacccggaucuaccagauccuggccaucuacagcaccgucgcguccagccucgugcugguggucucccugggggccaucagcuucuggaugugcagcaacggcucccuccagugccgcaucugcaucuga

SEQ ID NO: 64943 - RNA, 1701 nt, Artificial Sequence
  derived and/or modified sequence opt1 from hemagglutinin__InfluenzaA__ACZ98567
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaagucccccaagcugcggcucgcgagcggcaugcgcaacguccccuucauccagucccgggggcuguucggcgccaucaccggguucaucgaggagggcuggaccggcaugguggacgggugguacggcuuccaccaccagaacgagcaggggagcggcuacgccgccgaccugaaguccacgcagaacgccaucgacgagaucaccaacaaggugaacagcgucaucgagaagaugaacacccaguucaccgcgguggggaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucagccucggcgccaucuccuucuggaugugcagcaacgggucccugcagugccggaucugcaucuga

SEQ ID NO: 64944 - RNA, 1701 nt, Artificial Sequence; identical to SEQ ID NO: 63664
  derived and/or modified sequence opt1 from hemagglutinin__InfluenzaA__ACZ98671

SEQ ID NO: 64945 - RNA, 1701 nt, Artificial Sequence; identical to SEQ ID NO: 63664
  derived and/or modified sequence opt1 from hemagglutinin__InfluenzaA__ACZ98681

SEQ ID NO: 64946 - RNA, 1701 nt, Artificial Sequence; identical to SEQ ID NO: 63677
  derived and/or modified sequence opt1 from hemagglutinin__InfluenzaA__ACZ98691

SEQ ID NO: 64947 - RNA, 1701 nt, Artificial Sequence
  derived and/or modified sequence opt1 from hemagglutinin__InfluenzaA__ADA60799
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 64948 - RNA, 1701 nt, Artificial Sequence; identical to SEQ ID NO: 64841
  derived and/or modified sequence opt1 from hemagglutinin__InfluenzaA__ADA69302

SEQ ID NO: 64949 - RNA, 1701 nt, Artificial Sequence; identical to SEQ ID NO: 64841
  derived and/or modified sequence opt1 from hemagglutinin__InfluenzaA__ADA69312

SEQ ID NO: 64950 - RNA, 1701 nt, Artificial Sequence; identical to SEQ ID NO: 64841
  derived and/or modified sequence opt1 from hemagglutinin__InfluenzaA__ADA69322

SEQ ID NO: 64951 - RNA, 1701 nt, Artificial Sequence; identical to SEQ ID NO: 64841
  derived and/or modified sequence opt1 from hemagglutinin__InfluenzaA__ADA69332

SEQ ID NO: 64952 - RNA, 1701 nt, Artificial Sequence; identical to SEQ ID NO: 64778
  derived and/or modified sequence opt1 from hemagglutinin__InfluenzaA__ADA70329

SEQ ID NO: 64953 - RNA, 1698 nt, Artificial Sequence
  derived and/or modified sequence opt1 from hemagglutinin__InfluenzaA__ADA71150
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccuggucgagaacagccacaacgggaagcugugccuccugaagggcaucgcgccccugcagcucgggaacugcuccguggccggcuggauccuggggaacccggagugcgagcugcucaucagcaaggaguccuggagcuacaucguggagaagcccaaccccgagaacgggaccugcuaccccggccacuucgccgacuacgaggagcugcgcgagcagcuguccagcgucuccagcuucgagcgguucgagaucuucccgaaggaguccagcuggcccaaccacacggugaccgggguguccgccagcugcucccacaacggcgagagcuccuucuaccgcaaccuccuguggcugaccgggaagaacggccucuaccccaaccugagcaaguccuacgccaacaacaaggagaaggagguccuggugcucuggggcgugcaccacccgcccagcaucagcaaccagaagacccuguaccacacggagaacgccuacgucuccguggugagcucccacuacagccggaaguucacccccgagaucgccaagcgccccaagguccgggaccaggagggccgcaucaacuacuacuggacccugcucgagcccggcgacaccaucaucuucgaggccaacgggaaccugaucgcgccgcgguacgccuucgcccugucccgcggcuucgggagcggcaucaucaacuccaacgcccccauggacaagugcgacgccaagugccagacgccccagggcgcgaucaacagcucccuccccuuccagaacgugcacccggugaccaucggggagugccccaaguacguccggagcgccaagcugcgcauggugaccggccugcggaacauccccuccauccagagccgcggccucuucggggccaucgccggguucaucgagggcggcuggaccgggaugguggacggcugguacggguaccaccaccagaacgagcagggcuccggguacgccgcggaccagaaguccacgcagaacgccaucaacggcaucaccaagaaggucaacagcgugaucgagaagaugaacacccaguucaccgccgucggcaaggaguucaacaagcuggagcggcgcauggagaaccugaacaagaagguggacgacggguucaucgacaucuggacguacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggucaagcuggagagcaugggcguguaccagauccucgcgaucuacuccaccguggccagcucccugguccugcucgugagccugggcgccaucuccuucuggaugugcagcaacgggucccugcagugccggaucugcaucuga

SEQ ID NO: 64954 - RNA, 1701 nt, Artificial Sequence
  derived and/or modified sequence opt1 from hemagglutinin__InfluenzaA__ADA71152
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgggaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 64955 - RNA, 1698 nt, Artificial Sequence
  derived and/or modified sequence opt1 from hemagglutinin__InfluenzaA__ADA71154
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacagcgagugcgagcuccugaucuccaaggagagcugguccuacaucguggagaagccgaaccccgagaacgggaccugcuacuucggccacuucgccgacuacgaggagcugcgcgagcaguucgggagcguguccagcuucgagcgguucgagaucuuccccaaggaguccagcuggcccaaccacacggucaccggcguguccgccagcugcucccacaacggggagagcuccuucuaccgcaaccuccuguggcugaccggcaagaacgggcucuacccgaaccugagcaaguccuacgccaacaacaaggagaaggaggugcugguccucuggggcgugcaccacccgcccagcaucaacgaccagaagacccuguaccacacggagaacgccuacgugagcgucguguccagccacuacucccggaaguucacccccgagaucgccaagcgccccaaggugcgggaccaggagggccgcaucaacuacuacuggacccugcucgagccccgggacaccaucaucuucgaggccaacgggaaccugaucgcgccccgcuacgccuucgcccugagccggggcuucggguccggcaucaucaacagcaacgcccccauggacaagugcgacgccaagugccagacgccgcagggcgcgaucaacuccagccuccccuuccagaacguccaccccgugaccaucggggagugccccaaguacgugcgcuccgccaagcugcggauggucaccggccugcgcaacaucccgagcauccagucccggggccucuucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccugaacaagaaggucgacgacggguucaucgacaucuggacguacaacgccgagcuccuggugcugcucgagaacgagcgcacccuggacuuccacgacuccaacgugaagaaccuguacgagaaggucaagagccagcucaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggggugaagcuggagagcaugggcgucuaccagauccucgcgaucuacagcaccguggccuccagccuggugcugcucgucucccugggcgccaucagcuucuggaugugcuccaacgggagccugcagugccgcaucugcaucuga

SEQ ID NO: 64956 - RNA, 1698 nt, Artificial Sequence
  derived and/or modified sequence opt1 from hemagglutinin__InfluenzaA__ADA71158
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggagaccugguccuacaucguggagaagcccaaccccgagaacggcacgugcuaccccggccacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccuccaucaacgaccagcggacgcuguaccacaccgagaacgccuacgugagcgucgugagcucccacuacagccgcaaguucacccccgagaucgccaagcggcccaaggugcgcgaccaggaggggcggaucaacuacuacuggacccuccuggagccccgcgacacgaucaucuucgaggccaacggcaaccugaucgcgccgcgguacgccuucgcccucucccgcggguucggcagcgggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacacccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacgggaucaccaacaaggugaacagcgucaucgagaagaugaacacgcaguucaccgccgugggcaaggaguucaacaagcuggagagccucauggacauccugaacaagaaggucgacgacggcuucaucgacaucuggaccuacaacgccgagcugcucgugcugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcucaaccgcgagaagaucgacggcgugaagcuggagagcaugggggucuaccagauccuggcgaucuacagcaccguggccuccagccucgugcugcuggucucccucggcgccaucagcuucuggaugugcuccaacggcagccugcagugccggaucugcaucuga

SEQ ID NO: 64957 - RNA, 1701 nt, Artificial Sequence; identical to SEQ ID NO: 63442
  derived and/or modified sequence opt1 from hemagglutinin__InfluenzaA__ADA71162

SEQ ID NO: 64958 - RNA, 1698 nt, Artificial Sequence
  derived and/or modified sequence opt1 from hemagglutinin__InfluenzaA__ADA71164
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugagcaaggaguccuggagcuacaucguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccggggccuccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccuccaucgccgaccagaagacccuguaccacacggagaacgccuacgugagcgucgugagcucccacuacagccggaaguucacccccgagaucgcgaagcgccccaaggugcgggaccaggagggccgcauccacuacuacuggacccuccuggagcccggcgacaccaucaucuucgaggccaacgggaaccugaucgccccgcgguacgccuucgcccucucccgcggcuucgggagcggcaucaucaacuccaacgcgcccauggacaagugcgacgccacgugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgcgggguucaucgagggcggcuggaccgggaugguggacggcugguacggguaccaccaccagaacgagcagggcuccggguacgccgccgaccagaaguccacccagaacgccaucaacggcaucaccaacaaggugaacagcgucaucgagaagaugaacacccaguucacggccgugggcaaggaguucaacaagcuggagcggcgcauggagaaccucaacaagaaggucgacgacggguucaucgacaucuggaccuacaacgcggagcugcuggugcuccuggagaacgagcggacccuggacuuccacgacagcaacgugaagaaccucuacgagaaggucaucucccagcugaagaucaacgccaaggaccugggcuacgggugcuucgaguucuaccacaagugcaacgacgagugcauggagagcgugaagaacggcaccuacgacuaccccaaguacuccgaggagagcaagcucaaccgcgagaagaucgacggggugaagcuggaguccaugggcgucuaccagauccuggccaucuacagcacgguggccagcucccucgugcugcuggucagccucggcgccaucuccuucuggaugugcagcaacgggucccugcagugccggaucugcaucuga

SEQ ID NO: 64959 - RNA, 1698 nt, Artificial Sequence
  derived and/or modified sequence opt1 from hemagglutinin__InfluenzaA__ADA71168
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccgggcacuucgccgacuacgaggagcugcgggagcagcucagcuccgugagcuccuucgagcgcuucgagaucuucccgaaggagagcuccuggcccaaccacacggucaccggcgugagcgccuccugcagccacaacggggaguccagcuucuacaagaaccugcuguggcucaccggcaagaacgggcuguaccccaaccuguccaagagcuacgccaacaacaaggagaaggaggugcucguccuguggggcgugcaccacccgcccaacaucggcgugcagaugacccuguaccacaaggagaacgccuacgucuccguggugagcagccacuacucccggaaguucacgcccgagaucgucaagcgccccaaggugcgggaccaggaggggcgcaucaacuacuacuggacccuccuggagcccggcgacaccaucaucuucgaggccaacgggaaccugaucgccccgcgguacgcguucgcccucagccgcggcuucggcuccgggaucaucaacagcaacgcccccauggacgagugcgacgccaagugccagacgccccagggcgccaucaacuccagccugcccuuccagaacgugcacccggucaccaucggggagugccccaaguacgugcgguccgcgaagcugcgcauggugaccggccuccggaacauccccagcauccagucccgcgggcuguucggcgccaucgccggcuucaucgagggcggcuggaccgggauggucgacggcugguacggguaccaccaccagaacgagcagggcagcggcuacgccgccgaccagaaguccacccagaacgcgaucaacgggaucacgaacaaggugaacagcgucaucgagaagaugaacacccaguucaccgccgugggcaaggaguucaacaagcuggagcggcgcauggagaaccucaacaagaagguggacgacggguucaucgacaucuggaccuacaacgccgagcugcugguccuccuggagaacgagcggacgcuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcauggggguguaccagauccuggccaucuacuccaccgucgcgagcagccuggugcuccuggugucccugggcgccaucagcuucuggaugugcuccaacgggagccuccagugccggaucugcaucuga

SEQ ID NO: 64960 - RNA, 1698 nt, Artificial Sequence
  derived and/or modified sequence opt1 from hemagglutinin__InfluenzaA__ADA71170
augaaggugaagcugcucguccugcugugcaccuucaccgccacguacgccgacaccaucugcaucggcuaccacgcgaacaacagcaccgacaccguggacacggugcucgagaagaacgggaccgucacccccuccggcaaccugguggagaacagcccgaacgggaagcugugccuccugaagggcaucaccccgcugcagcucgggaagugcuccguggccggcuggauccugggcaaccccaagugggagcugcucgucagcaaggaguccuggagcuacaucgggaagaagcccaaccccgagaacggcacgugcuaccccgggcacuuccccuacuacgaggagcugcgcgagcagcuguccagcguguccagcuucgagcgguucgagaucuuccccaaggaguccagcuggccgaaccacaccgugaccggcgccuccgccagcugcucccacaacggggagaacagcuucuaccgcaaccuccuguggcugaccggcaagaacggccucuaccccaaccuguccaagagcuacgccaacaacaaggagaaggagguccuggugcucuggggcgugcaccacccgcccaacaucgcggaccagaagacgcuguaccacaccgagaacgccuacgucuccguggugagcagccacuacucccggaaguucacccccgagaucgccaagcgccccaagguccgggaccaggaggggcgcaucaacuacuacuggacccugcucgagcccggggacacgaucaucuucgaggccaacggcaaccugaucgcgccccgguacgccuucgcccugagccgcggcuucggguccggcaucaucaacagcaacgccccgauggacaagugcgacgccaagugccagacgccccagggggcgaucaacuccagccuccccuuccagaacgugcaccccgugaccaucggcgagugcccgaaguacguccgguccgccaagcugcgcauggugaccgggcugcggaacauccccagcauccagucccgcggccucuucggcgccaucgccggguucaucgagggcggguggaccggcaugguggacgggugguacggcuaccaccaccagaacgagcagggcagcggguacgccgcggaccagaaguccacccagaacgccaucaacggcaucaccaacaaggucaacagcgugaucgagaagaugaacacccaguucacggccguggggaaggaguucaacaagcuggagcggcgcauggagaaccugaacaagaaggucgacgacggcuucaucgacaucuggaccuacaacgccgagcuccuggugcugcucgagaacgagcggacccuggacuuccacgacuccaacgucaagaaccuguacgagaaggucaagagccagcucaagaacaacgccaaggagaucgggaacggcugcuucgaguucuaccacaagugcaacgacgagugcauggaguccgugaagaacggcaccuacgacuaccccaaguacagcgaggaguccaagcugaaccgcgagaagaucgacggggugaagcuggagagcaugggcguguaccagauccucgcgaucuacuccacgguggccagcagccugguccugcucgugucccugggggccaucagcuucuggaugugcuccaacggcagccugcagugccggaucugcaucuga

SEQ ID NO: 64961 - RNA, 1701 nt, Artificial Sequence
  derived and/or modified sequence opt1 from hemagglutinin__InfluenzaA__ADA71172
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcccaggcgagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacagcgaggggcggggccaggccgccgaccugaaguccacccaggccgcgaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcacguacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 64962 - RNA, 1698 nt, Artificial Sequence
  derived and/or modified sequence opt1 from hemagglutinin__InfluenzaA__ADA71176
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggggccuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccaaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccacgugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacccagaacgccaucaacggcaucaccaacaaggugaacagcgugaucgagaagaugaacacccaguucacggccgucggcaaggaguucaacaagcuggagcggcgcauggagaaccucaacaagaagguggacgacggguucaucgacaucuggaccuacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccacggucgccagcagccuggugcuccuggugucccugggcgccaucagcuucuggaugugcuccaacgggagccuccagugccggaucugcaucuga

SEQ ID NO: 64963 - RNA, 1701 nt, Artificial Sequence; identical to SEQ ID NO: 64778
  derived and/or modified sequence opt1 from hemagglutinin__InfluenzaA__ADA71181

SEQ ID NO: 64964 - RNA, 1701 nt, Artificial Sequence; identical to SEQ ID NO: 64778
  derived and/or modified sequence opt1 from hemagglutinin__InfluenzaA__ADA71191

SEQ ID NO: 64965 - RNA, 1701 nt, Artificial Sequence
  derived and/or modified sequence opt1 from hemagglutinin__InfluenzaA__ADA79587
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacaucccgagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 64966 - RNA, 1701 nt, Artificial Sequence
  derived and/or modified sequence opt1 from hemagglutinin__InfluenzaA__ADA79607
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 64967 - RNA, 1701 nt, Artificial Sequence
  derived and/or modified sequence opt1 from hemagglutinin__InfluenzaA__ADA83043
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 64968 - RNA, 1701 nt, Artificial Sequence
  derived and/or modified sequence opt1 from hemagglutinin__InfluenzaA__ADA83044
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccaacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcugaacaaguccuacaucaacgacaaggggaaggaggugcugguccucuggggcauccaccaccccagcaccagcgccgaccagcagucccuguaccagaacgccgacgccuacguguucguggggacgagccgguacuccaagaaguucaagcccgagaucgccauccgcccgaagguccggggccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccgacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 64969 - RNA, 1701 nt, Artificial Sequence; identical to SEQ ID NO: 63677
  derived and/or modified sequence opt1 from hemagglutinin__InfluenzaA__ADA83580

SEQ ID NO: 64970 - RNA, 1701 nt, Artificial Sequence; identical to SEQ ID NO: 63677
  derived and/or modified sequence opt1 from hemagglutinin__InfluenzaA__ADA83587

SEQ ID NO: 64971 - RNA, 1701 nt, Artificial Sequence
  derived and/or modified sequence opt1 from hemagglutinin__InfluenzaA__ADA83591
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucuccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64972 - RNA, 1701 nt, Artificial Sequence; identical to SEQ ID NO: 64422
  derived and/or modified sequence opt1 from hemagglutinin__InfluenzaA__ADA83595

SEQ ID NO: 64973 - RNA, 1701 nt, Artificial Sequence; identical to SEQ ID NO: 63677
  derived and/or modified sequence opt1 from hemagglutinin__InfluenzaA__ADA83599

SEQ ID NO: 64974 - RNA, 1701 nt, Artificial Sequence; identical to SEQ ID NO: 63677
  derived and/or modified sequence opt1 from hemagglutinin__InfluenzaA__ADA83603

SEQ ID NO: 64975 - RNA, 1701 nt, Artificial Sequence; identical to SEQ ID NO: 63677
  derived and/or modified sequence opt1 from hemagglutinin__InfluenzaA__ADA83611

SEQ ID NO: 64976 - RNA, 1701 nt, Artificial Sequence
  derived and/or modified sequence opt1 from hemagglutinin__InfluenzaA__ADA83615
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgaccucaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 64977 - RNA, 1701 nt, Artificial Sequence
  derived and/or modified sequence opt1 from hemagglutinin__InfluenzaA__ADA83622
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagcggcuguaccagaacgccgacgccuacguguucgugggcacgagccgcuacuccaagaagcugaagcccgagaucgccauccggccgaagguccgcgaccaggagggccggaugaacuacuacuggacccucguggagcccggggacaagaucaccuucgaggcgaccggcaaccugguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgcgaggagaucgacggcgugaagcuggaguccacccggaucuaccagauccuggcgaucuacagcaccgucgccuccagccucgugcugguggucagccugggggccaucuccuucuggaugugcagcaacggcucccuccagugccgcaucugcaucuga

SEQ ID NO: 64978 - RNA, 1701 nt, Artificial Sequence; identical to SEQ ID NO: 63677
  derived and/or modified sequence opt1 from hemagglutinin__InfluenzaA__ADA83633

SEQ ID NO: 64979 - RNA, 1701 nt, Artificial Sequence; identical to SEQ ID NO: 63677
  derived and/or modified sequence opt1 from hemagglutinin__InfluenzaA__ADA83637

SEQ ID NO: 64980 - RNA, 1701 nt, Artificial Sequence; identical to SEQ ID NO: 63677
  derived and/or modified sequence opt1 from hemagglutinin__InfluenzaA__ADA83641

SEQ ID NO: 64981 - RNA, 1701 nt, Artificial Sequence; identical to SEQ ID NO: 63677
  derived and/or modified sequence opt1 from hemagglutinin__InfluenzaA__ADA83645

SEQ ID NO: 64982 - RNA, 1701 nt, Artificial Sequence; identical to SEQ ID NO: 63677
  derived and/or modified sequence opt1 from hemagglutinin__InfluenzaA__ADA83648

SEQ ID NO: 64983 - RNA, 1701 nt, Artificial Sequence; identical to SEQ ID NO: 63677
  derived and/or modified sequence opt1 from hemagglutinin__InfluenzaA__ADA83656

SEQ ID NO: 64984 - RNA, 1701 nt, Artificial Sequence; identical to SEQ ID NO: 63677
  derived and/or modified sequence opt1 from hemagglutinin__InfluenzaA__ADA83660

SEQ ID NO: 64985 - RNA, 1701 nt, Artificial Sequence
  derived and/or modified sequence opt1 from hemagglutinin__InfluenzaA__ADA83664
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaccgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64986 - RNA, 1701 nt, Artificial Sequence
  derived and/or modified sequence opt1 from hemagglutinin__InfluenzaA__ADA83668
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 64987 - RNA, 1701 nt, Artificial Sequence; identical to SEQ ID NO: 63677
  derived and/or modified sequence opt1 from hemagglutinin__InfluenzaA__ADA83672

SEQ ID NO: 64988 - RNA, 1701 nt, Artificial Sequence; identical to SEQ ID NO: 63677
  derived and/or modified sequence opt1 from hemagglutinin__InfluenzaA__ADA83676

SEQ ID NO: 64989 - RNA, 1701 nt, Artificial Sequence; identical to SEQ ID NO: 63677
  derived and/or modified sequence opt1 from hemagglutinin__InfluenzaA__ADA83680

SEQ ID NO: 64990 - RNA, 1701 nt, Artificial Sequence
  derived and/or modified sequence opt1 from hemagglutinin__InfluenzaA__ADA86068
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaucaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64991 - RNA, 1701 nt, Artificial Sequence
  derived and/or modified sequence opt1 from hemagglutinin__InfluenzaA__ADA86086
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaacgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 64992 - RNA, 1701 nt, Artificial Sequence
  derived and/or modified sequence opt1 from hemagglutinin__InfluenzaA__ADA86087
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuucuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgcccugaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcucccucgugcugguggucagccugggggccaucagcuucuggaugugcuccaacggcagccuccagugccggaucugcaucuga

SEQ ID NO: 64993 - RNA, 1701 nt, Artificial Sequence; identical to SEQ ID NO: 64475
  derived and/or modified sequence opt1 from hemagglutinin__InfluenzaA__ADA86088

SEQ ID NO: 64994 - RNA, 1701 nt, Artificial Sequence
  derived and/or modified sequence opt1 from hemagglutinin__InfluenzaA__ADB03603
augaaggccauccugaucgugcuccuguacaccuucgccaccgcgcacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcauggacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 64995 - RNA, 1701 nt, Artificial Sequence; identical to SEQ ID NO: 63664
  derived and/or modified sequence opt1 from hemagglutinin__InfluenzaA__ADB03604

SEQ ID NO: 64996 - RNA, 1701 nt, Artificial Sequence
  derived and/or modified sequence opt1 from hemagglutinin__InfluenzaA__ADB03605
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcauggacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64997 - RNA, 1701 nt, Artificial Sequence; identical to SEQ ID NO: 63677
  derived and/or modified sequence opt1 from hemagglutinin__InfluenzaA__ADB03607

SEQ ID NO: 64998 - RNA, 1701 nt, Artificial Sequence; identical to SEQ ID NO: 64030
  derived and/or modified sequence opt1 from hemagglutinin__InfluenzaA__ADB03609

SEQ ID NO: 64999 - RNA, 1701 nt, Artificial Sequence; identical to SEQ ID NO: 63677
  derived and/or modified sequence opt1 from hemagglutinin__InfluenzaA__ADB03611

SEQ ID NO: 65000 - RNA, 1701 nt, Artificial Sequence
  derived and/or modified sequence opt1 from hemagglutinin__InfluenzaA__ADB03612
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguucauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65001 - RNA, 1701 nt, Artificial Sequence; identical to SEQ ID NO: 63677
  derived and/or modified sequence opt1 from hemagglutinin__InfluenzaA__ADB03614

SEQ ID NO: 65002 - RNA, 1701 nt, Artificial Sequence
  derived and/or modified sequence opt1 from hemagglutinin__InfluenzaA__ADB03617
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65003 - RNA, 1701 nt, Artificial Sequence; identical to SEQ ID NO: 64030
  derived and/or modified sequence opt1 from hemagglutinin__InfluenzaA__ADB03619

SEQ ID NO: 65004 - RNA, 1701 nt, Artificial Sequence
  derived and/or modified sequence opt1 from hemagglutinin__InfluenzaA__ADB03620
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucguccccaagaccagcuccuggcccaaccacgacagcaacaagggcgugaccgccgccugcccgcacgccggggcgaaguccuucuacaagaaccugaucuggcucgugaagaagggcaacagcuaccccaagcuguccaagagcuacaucaacgacaaggggaaggagguccuggugcucuggggcauccaccaccccagcaccuccgccgaccagcagagccuguaccagaacgccgacgccuacguguucgucggcacgucccgguacagcaagaaguucaagcccgagaucgccauccgcccgaaggugcgggaccaggaggggcgcaugaacuacuacuggacccugguggagcccggcgacaagaucaccuucgaggcgaccgggaaccucgucgugccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaacggcagccugcagugccggaucugcaucuga

SEQ ID NO: 65005 - RNA, 1701 nt, Artificial Sequence
  derived and/or modified sequence opt1 from hemagglutinin__InfluenzaA__ADB03622
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65006 - RNA, 1701 nt, Artificial Sequence; identical to SEQ ID NO: 65005
  derived and/or modified sequence opt1 from hemagglutinin__InfluenzaA__ADB03623

SEQ ID NO: 65007 - RNA, 1701 nt, Artificial Sequence
  derived and/or modified sequence opt1 from hemagglutinin__InfluenzaA__ADB03628
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65008 - RNA, 1701 nt, Artificial Sequence
  derived and/or modified sequence opt1 from hemagglutinin__InfluenzaA__ADB03629
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguuccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65009 - RNA, 1701 nt, Artificial Sequence
  derived and/or modified sequence opt1 from hemagglutinin__InfluenzaA__ADB03630
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65010 - RNA, 1701 nt, Artificial Sequence; identical to SEQ ID NO: 64422
  derived and/or modified sequence opt1 from hemagglutinin__InfluenzaA__ADB25319

SEQ ID NO: 65011 - RNA, 1701 nt, Artificial Sequence; identical to SEQ ID NO: 63677
  derived and/or modified sequence opt1 from hemagglutinin__InfluenzaA__ADB25321

SEQ ID NO: 65012 - RNA, 1701 nt, Artificial Sequence
  derived and/or modified sequence opt1 from hemagglutinin__InfluenzaA__ADB27970
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65013 - RNA, 1701 nt, Artificial Sequence; identical to SEQ ID NO: 63677
  derived and/or modified sequence opt1 from hemagglutinin__InfluenzaA__ADB27980

SEQ ID NO: 65014 - RNA, 1701 nt, Artificial Sequence; identical to SEQ ID NO: 63677
  derived and/or modified sequence opt1 from hemagglutinin__InfluenzaA__ADB54352

SEQ ID NO: 65015 - RNA, 1701 nt, Artificial Sequence; identical to SEQ ID NO: 63677
  derived and/or modified sequence opt1 from hemagglutinin__InfluenzaA__ADB54355

SEQ ID NO: 65016 - RNA, 1698 nt, Artificial Sequence
  derived and/or modified sequence opt1 from hemagglutinin__InfluenzaA__ADB65926
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaagcacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaagggcagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggggaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggcuucggguccggcaucaucaacagcaacgcccccauggacgagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggcgccaucgccggguucaucgagggcggguggaccggcaugguggacgggugguacggcuaccaccaccagaacgagcagggcagcggguacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugaagaacaacgccaaggagauggggaacggcugcuucgaguucuaccacaagugcaacgacgagugcauggagagcgugaagaacggcaccuacgacuaccccaaguacuccgaggagagcaagcugucccgcgagaagaucgacggggucaagcucgagagcaugggcguguaccagauccuggcgaucuacuccaccguggccagcagccugguccuccuggugucccugggggccaucggcuucuggaugugcagcaacggcucccuccagugccggaucugcaucuga

SEQ ID NO: 65017 - RNA, 1698 nt, Artificial Sequence
  derived and/or modified sequence opt1 from hemagglutinin__InfluenzaA__ADB80153
augaaggugaagcugcucgcccugcugugcaccuucaccgccacguacgcggacaccaucugcaucggcuaccacgccaacaacagcaccgacaccgucgacacggugcucgagaagaacgugaccgucacccacuccgugaaccugcuggaggacaaccacaacgggaagcucugccugcugaagggcaucgcgccccuccagcuggggaacugcagcguggccggcuggauccuggggaacccggagugcgagcuccugaucuccaaggagagcugguccuacaucgucgagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggugaccggggucagcgccuccugcagccacaacggcgaguccagcuucuacaagaaccugcuguggcucaccgggaagaacggccuguaccccaaccuguccaagagcuucgccaacaacaaggagaaggaggugcucgugcuguggggcguccaccacccgcccaacaucggcgaccagaugacccuguaccacaaggagaacgccuacguguccguggucagcagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucaacagcaacgcccccauggacgagugcgacgcgaagugccagacgccccagggggccaucaacuccagccugcccuuccagaacgugcacccggucaccaucggcgagugccccaaguacgugcgcuccaccaagcugcggauggugaccgggcuccgcaacauccccagcauccagucccggggccuguucggggccaucgccggcuucaucgagggcggguggaccggcauggucgacgggugguacggcuaccaccaccagaacgagcaggggagcggcuacgccgcggaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacgucuggacguacaacgccgagcugcuggugcuccuggagaacgagcgcacccuggacuuccacgacuccaacgugaagaaccucuacgagaaggucaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgugaagcucgagagcaugggcgucuaccagauccuggcgaucuacuccaccguggccagcagccuggugcuccuggucucccugggggccaucagcuucuggaugugcuccaacggcagccuccagugccgcaucugcaucuga

SEQ ID NO: 65018 - RNA, 1701 nt, Artificial Sequence; identical to SEQ ID NO: 64778
  derived and/or modified sequence opt1 from hemagglutinin__InfluenzaA__ADB81399

SEQ ID NO: 65019 - RNA, 1701 nt, Artificial Sequence; identical to SEQ ID NO: 64778
  derived and/or modified sequence opt1 from hemagglutinin__InfluenzaA__ADB81409

SEQ ID NO: 65020 - RNA, 1701 nt, Artificial Sequence
  derived and/or modified sequence opt1 from hemagglutinin__InfluenzaA__ADB81419
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccgaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65021 - RNA, 1701 nt, Artificial Sequence; identical to SEQ ID NO: 64837
  derived and/or modified sequence opt1 from hemagglutinin__InfluenzaA__ADB81429

SEQ ID NO: 65022 - RNA, 1701 nt, Artificial Sequence
  derived and/or modified sequence opt1 from hemagglutinin__InfluenzaA__ADB81439
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccggaaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65023 - RNA, 1701 nt, Artificial Sequence
  derived and/or modified sequence opt1 from hemagglutinin__InfluenzaA__ADB81449
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65024 - RNA, 1701 nt, Artificial Sequence
  derived and/or modified sequence opt1 from hemagglutinin__InfluenzaA__ADB81459
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgggggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgucccgagcauccagucccggggccuguucggggcgaucgccggcuucaucgagggcggguggacgggcaugguggacgggugguacggcuaccaccaccagaacgagcaggggagcggcuacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucagccugggcgccaucuccuucuggaugugcagcaacggcucccugcagugccggaucugcaucuga

SEQ ID NO: 65025 - RNA, 1701 nt, Artificial Sequence
  derived and/or modified sequence opt1 from hemagglutinin__InfluenzaA__ADB82655
augaaggccauccugcucgugcugcugugcacccucgccgcggccaacgccgacacccugugcaucggcuaccacgccaacaacagcacggacaccgucgacaccgugcuggagaagaacgugaccgucacgcacuccgugaaccuccuggaggaccgccacaacgggaagcugugcaaccuccggggcaaggcgccccugcaccuggggaagugcaacaucgccggcuggcuccuggggaacccggagugcgagcuccuguucgccgugaacagcugguccuacaucgucgagaccagcaacuccgacaacgggaccugcuaccccggcgacuucaccagcuacgaggagcugcgcgagcagcuguccagcguguccagcuucgagcgguucgagaucuuccccaaggccuccagcuggcccaaccacgagacgaaccgcggcgugaccgccgcgugcccguacgccggcaccaacggguucuaccggaaccucaucuggcuggucaagaaggagaacuccuaccccaagcugcgcaagagcuacgugaacaacaagaagaaggaggugcucguccuguggggcauccaccacccgcccaccaacacggaccagcagucccuguaccagaacgccgacgccuacguguucguggggagcuccaaguacagccggaaguucaagcccgagaucgccgagcgccccaagguccggggccaggcgggccgcaugaacuacuacuggacccucaucgagcccggggacaccaucaccuucgaggccacgggcaaccugguggcgccccgguacgccuucgccaugaaccgcgggccgguguccggcaucaucaccagcgacgcccccguccacgacugcaacgcgaccugccagacccccaagggcgccaucaacacgagccugcccuuccagaacauccacccgaucaccaucggggagugccccaaguacgugaaguccacccggcuccgcauggccaccggccugcggaacauccccagcauccagucccgcgggcuguucggcgccaucgccggguucaucgagggcggcuggacggggaugaucgacggcugguacggguaccaccaccagaacggccaggggagcggcuacgccgccgaccagaaguccacccagaacgccaucgaccggaucaccaacaaggugaacagcgucaucgagaagaugaacauccaguucaccgccgugggcaaggaguucaaccaccucgagcgccggaucgagaaccugaacaagaagguggacgacggguuccuggacgucuggacguacaacgcggagcuccuggugcugcucgagaacgagcgcacccuggacuuccacgacuccaacgucaagacccuguacgagaaggugaagacccagcuccggaacaacgccaaggagaucggcaacgggugcuucgaguucuaccacaagugcgacgacacgugcauggagagcaucaagaacggcaccuacaacuaccccaaguacuccgaggagagcaagcugaaccgcgaggagaucgacggggugaagcuggaguccacccgcaucuaccagauccucgccaucuacagcaccgccgcguccagccugguccugcucgugucccugggcgccaucggcuucuggaugugcagcaacgggucccugcagugccggaucugcaucuga

SEQ ID NO: 65026 - RNA, 1701 nt, Artificial Sequence
  derived and/or modified sequence opt1 from hemagglutinin__InfluenzaA__ADB82656
augaaggccauccugcucgugcugcagugcauccugaccgccgcgaacgccgacacccucugcaucggcuaccacgccaacaacagcacggacaccgucgacaccgugcuggagaagaacgugaccgucacgcacuccgugaaccugcucgaggaccgccacaacgggaagcugugcaagcugaagggcaucgcgccccuccaccuggggaagugcaacaucgccggcuggcugcucgggaacccggagugcgagcugcuguucaaggccaacagcugguccuacaucguggagaccagcuacuccgacaacgggaccugcuaccccggcgacuucaccaacuacgaggagcuccgggagcagcugagcuccgucagcuccuucgagcgcuucgagauguuccccaaggccaacagcuggcccaaccacgagacgaacaagggggugaccgccgccugcccguacgcgggcgccaacuccuucuaccggaaccugaucuggcucgugaagaaggggaacagcuacccccgccuguccaagagcuacgucaacaacaagaagaaggaggugcuggugcucuggggcauccaccaccccuccaccagcaccgaccagcagucccuguaccagaacgccgacgccuacgucuucgugagcuccagcacguacaacaagcgguucaagcccgagaucgggacccgcccgaaggugcgggaccagagcggccgcaugaacuacuacuggaccaucgucgagcccggcgacaccaucacguucgaggccaccgggaaccugguggcgccccgguacgccuucgccaugaagcgcgacuccggcagcgggaucaucauguccgacacccccgugcacgacugcaacaccacgugccagaccccgaagggcgccaucaacaccagccuccccuuccagaacguccaccccgugaccaucggcgagugccccaaguacgugaaguccacgaagcugcggauggccaccgggcugcgcaacaucccgagcauccagucccggggccucuucggggcgaucgccggcuucaucgagggcggcuggaccggcaugaucgacgggugguacggcuaccaccaccagaacgagcaggggagcggcuacgccgccgaccgcaaguccacccagaacgccaucgacgggaucacgaacaaggucaacagcaucaucgagaagaugaacauccaguucaccgcggugggcaaggaguucucccaccuggagaagcggguggagaaccugaacaagaaggucgacgacggcuuccucgacguguggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacgacagcugcauggaguccaucaagaacgagacguacgacuacagcaaguacuccgaggagagccgccugaaccgggagaagaucgacggggucaagcucgaguccacccagaucuaccagauccuggccaucuacagcaccguggccagcucccuggugcuccuggucagccugggcgcgaucuccuucuggaugugcagcaacgggucccuccagugccgcaucugcaucuga

SEQ ID NO: 65027 - RNA, 1701 nt, Artificial Sequence
  derived and/or modified sequence opt1 from hemagglutinin__InfluenzaA__ADB82944
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacauccccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 65028 - RNA, 1701 nt, Artificial Sequence
  derived and/or modified sequence opt1 from hemagglutinin__InfluenzaA__ADB82950
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucgagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65029 - RNA, 1701 nt, Artificial Sequence; identical to SEQ ID NO: 64475
  derived and/or modified sequence opt1 from hemagglutinin__InfluenzaA__ADB89129

SEQ ID NO: 65030 - RNA, 1701 nt, Artificial Sequence; identical to SEQ ID NO: 63677
  derived and/or modified sequence opt1 from hemagglutinin__InfluenzaA__ADB89139

SEQ ID NO: 65031 - RNA, 1701 nt, Artificial Sequence
  derived and/or modified sequence opt1 from hemagglutinin__InfluenzaA__ADB89149
augaaggccauccuggugguccuccuguacaccuucgccaccgcgaacgccuacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgugggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcggggccaggaggggcgcaugaacuacuacuggacccugguggagcccggcgacaagaucaccuucgaggccaccgggaaccucgucgugccccgguacgcguucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgccaccgggcugcgcaacaucccguccauccagagccggggccuguucggggcgaucgccggcuucaucgagggcggguggacgggcaugguggacgggugguacggcuaccaccaccagaacgagcagggguccggcuacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 65032 - RNA, 1701 nt, Artificial Sequence; identical to SEQ ID NO: 64030
  derived and/or modified sequence opt1 from hemagglutinin__InfluenzaA__ADB89150

SEQ ID NO: 65033 - RNA, 1701 nt, Artificial Sequence
  derived and/or modified sequence opt1 from hemagglutinin__InfluenzaA__ADB89221
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagaaccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65034 - RNA, 1701 nt, Artificial Sequence; identical to SEQ ID NO: 63730
  derived and/or modified sequence opt1 from hemagglutinin__InfluenzaA__ADB89241

SEQ ID NO: 65035 - RNA, 1701 nt, Artificial Sequence; identical to SEQ ID NO: 63677
  derived and/or modified sequence opt1 from hemagglutinin__InfluenzaA__ADB89251

SEQ ID NO: 65036 - RNA, 1701 nt, Artificial Sequence; identical to SEQ ID NO: 64124
  derived and/or modified sequence opt1 from hemagglutinin__InfluenzaA__ADB89261

SEQ ID NO: 65037 - RNA, 1701 nt, Artificial Sequence
  derived and/or modified sequence opt1 from hemagglutinin__InfluenzaA__ADB89271
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaugggguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 65038 - RNA, 1701 nt, Artificial Sequence
  derived and/or modified sequence opt1 from hemagglutinin__InfluenzaA__ADB89281
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccacccgcccaccagcgccgaccagcagucccuguaccagaacgccgacgccuacguguucgugggcacgagccgguacuccaagaaguucaagcccgagaucgccauccgccccaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgccggugcacgacugcaacacgaccugccagacccccaagggggccaucaacaccagccugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65039 - RNA, 1701 nt, Artificial Sequence; identical to SEQ ID NO: 63677
  derived and/or modified sequence opt1 from hemagglutinin__InfluenzaA__ADB89291

SEQ ID NO: 65040 - RNA, 1701 nt, Artificial Sequence; identical to SEQ ID NO: 63677
  derived and/or modified sequence opt1 from hemagglutinin__InfluenzaA__ADB89301

SEQ ID NO: 65041 - RNA, 1701 nt, Artificial Sequence; identical to SEQ ID NO: 63677
  derived and/or modified sequence opt1 from hemagglutinin__InfluenzaA__ADB89311

SEQ ID NO: 65042 - RNA, 1701 nt, Artificial Sequence
  derived and/or modified sequence opt1 from hemagglutinin__InfluenzaA__ADB89321
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccgagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65043 - RNA, 1701 nt, Artificial Sequence
  derived and/or modified sequence opt1 from hemagglutinin__InfluenzaA__ADB89331
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccgggucuaccagauccuggcgaucuacagcaccguggccagcucccuggugcucgucgugagccugggggccaucuccuucuggaugugcagcaacggcucccugcagugccgcaucugcaucuga

SEQ ID NO: 65044 - RNA, 1701 nt, Artificial Sequence; identical to SEQ ID NO: 63677
  derived and/or modified sequence opt1 from hemagglutinin__InfluenzaA__ADB89341

SEQ ID NO: 65045 - RNA, 1701 nt, Artificial Sequence; identical to SEQ ID NO: 63677
  derived and/or modified sequence opt1 from hemagglutinin__InfluenzaA__ADB89351

SEQ ID NO: 65046 - RNA, 1701 nt, Artificial Sequence; identical to SEQ ID NO: 63677
  derived and/or modified sequence opt1 from hemagglutinin__InfluenzaA__ADB89361

SEQ ID NO: 65047 - RNA, 1701 nt, Artificial Sequence; identical to SEQ ID NO: 63677
  derived and/or modified sequence opt1 from hemagglutinin__InfluenzaA__ADB89371

SEQ ID NO: 65048 - RNA, 1701 nt, Artificial Sequence; identical to SEQ ID NO: 64422
  derived and/or modified sequence opt1 from hemagglutinin__InfluenzaA__ADB89381

SEQ ID NO: 65049 - RNA, 1701 nt, Artificial Sequence
  derived and/or modified sequence opt1 from hemagglutinin__InfluenzaA__ADB89391
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacagcuacccgaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagagccgggggcuguucggcgccaucgccggguucaucgagggcggcuggacggggaugaucgacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65050 - RNA, 1701 nt, Artificial Sequence; identical to SEQ ID NO: 63664
  derived and/or modified sequence opt1 from hemagglutinin__InfluenzaA__ADB89401

SEQ ID NO: 65051 - RNA, 1701 nt, Artificial Sequence; identical to SEQ ID NO: 63677
  derived and/or modified sequence opt1 from hemagglutinin__InfluenzaA__ADB89411

SEQ ID NO: 65052 - RNA, 1701 nt, Artificial Sequence; identical to SEQ ID NO: 64124
  derived and/or modified sequence opt1 from hemagglutinin__InfluenzaA__ADB89431

SEQ ID NO: 65053 - RNA, 1701 nt, Artificial Sequence; identical to SEQ ID NO: 64030
  derived and/or modified sequence opt1 from hemagglutinin__InfluenzaA__ADB89441

SEQ ID NO: 65054 - RNA, 1701 nt, Artificial Sequence; identical to SEQ ID NO: 63677
  derived and/or modified sequence opt1 from hemagglutinin__InfluenzaA__ADB89461

SEQ ID NO: 65055 - RNA, 1701 nt, Artificial Sequence; identical to SEQ ID NO: 64124
  derived and/or modified sequence opt1 from hemagglutinin__InfluenzaA__ADB89481

SEQ ID NO: 65056 - RNA, 1701 nt, Artificial Sequence; identical to SEQ ID NO: 64124
  derived and/or modified sequence opt1 from hemagglutinin__InfluenzaA__ADB89491

SEQ ID NO: 65057 - RNA, 1701 nt, Artificial Sequence
  derived and/or modified sequence opt1 from hemagglutinin__InfluenzaA__ADB89501
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggcucguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccagcucccucgugcugguggucagccugggggccaucuccuucuggaugugcagcaacggcucccuccagugccggaucugcaucuga

SEQ ID NO: 65058 - RNA, 1701 nt, Artificial Sequence; identical to SEQ ID NO: 63677
  derived and/or modified sequence opt1 from hemagglutinin__InfluenzaA__ADB89511

SEQ ID NO: 65059 - RNA, 1701 nt, Artificial Sequence; identical to SEQ ID NO: 64124
  derived and/or modified sequence opt1 from hemagglutinin__InfluenzaA__ADB89531

SEQ ID NO: 65060 - RNA, 1701 nt, Artificial Sequence; identical to SEQ ID NO: 64124
  derived and/or modified sequence opt1 from hemagglutinin__InfluenzaA__ADB89541

SEQ ID NO: 65061 - RNA, 1701 nt, Artificial Sequence; identical to SEQ ID NO: 64837
  derived and/or modified sequence opt1 from hemagglutinin__InfluenzaA__ADB89551

SEQ ID NO: 65062 - RNA, 1701 nt, Artificial Sequence; identical to SEQ ID NO: 63677
  derived and/or modified sequence opt1 from hemagglutinin__InfluenzaA__ADB89561

SEQ ID NO: 65063 - RNA, 1701 nt, Artificial Sequence; identical to SEQ ID NO: 63677
  derived and/or modified sequence opt1 from hemagglutinin__InfluenzaA__ADB89571

SEQ ID NO: 65064 - RNA, 1701 nt, Artificial Sequence; identical to SEQ ID NO: 63677
  derived and/or modified sequence opt1 from hemagglutinin__InfluenzaA__ADB89581

SEQ ID NO: 65065 - RNA, 1701 nt, Artificial Sequence
  derived and/or modified sequence opt1 from hemagglutinin__InfluenzaA__ADB89591
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacugggcgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccacagcaucacgaucgggaagugccccaaguacgugaaguccaccaagcugcggcucgccaccggccugcgcaacguccccagcauccagucccgggggcuguucggcgccaucgccggguucaucgagggcggcuggaccgggaugguggacggcugguacggguaccaccaccagaacgagcagggcagcggguacgccgcggaccucaaguccacgcagaacgccaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggcgaagcugaaccgggaggagaucgacggcgugaagcucgaguccacccgcaucuaccagauccuggccaucuacagcaccgucgccagcucccuggugcucguggucagccugggggccaucuccuucuggaugugcagcaacggcucccugcagugccggaucugcaucuga

SEQ ID NO: 65066 - RNA, 1701 nt, Artificial Sequence
  derived and/or modified sequence opt1 from hemagglutinin__InfluenzaA__ADB89601
augaaggccaucaucgugguccugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucaccaucuacuccaccgucgcgagcagccuggugcugguggucucccucggggccaucagcuucuggaugugcuccaacggcagccugcagugccggaucugcaucuga

SEQ ID NO: 65067 - RNA, 1701 nt, Artificial Sequence; identical to SEQ ID NO: 64841
  derived and/or modified sequence opt1 from hemagglutinin__InfluenzaA__ADB89611

SEQ ID NO: 65068 - RNA, 1701 nt, Artificial Sequence; identical to SEQ ID NO: 64841
  derived and/or modified sequence opt1 from hemagglutinin__InfluenzaA__ADB89621

SEQ ID NO: 65069 - RNA, 1701 nt, Artificial Sequence
  derived and/or modified sequence opt1 from hemagglutinin__InfluenzaA__ADB89631
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65070 - RNA, 1701 nt, Artificial Sequence; identical to SEQ ID NO: 64841
  derived and/or modified sequence opt1 from hemagglutinin__InfluenzaA__ADB89641

SEQ ID NO: 65071 - RNA, 1701 nt, Artificial Sequence; identical to SEQ ID NO: 63677
  derived and/or modified sequence opt1 from hemagglutinin__InfluenzaA__ADB89651

SEQ ID NO: 65072 - RNA, 1701 nt, Artificial Sequence; identical to SEQ ID NO: 63677
  derived and/or modified sequence opt1 from hemagglutinin__InfluenzaA__ADB89661

SEQ ID NO: 65073 - RNA, 1701 nt, Artificial Sequence; identical to SEQ ID NO: 64841
  derived and/or modified sequence opt1 from hemagglutinin__InfluenzaA__ADB89671

SEQ ID NO: 65074 - RNA, 1701 nt, Artificial Sequence; identical to SEQ ID NO: 63677
  derived and/or modified sequence opt1 from hemagglutinin__InfluenzaA__ADB89681

SEQ ID NO: 65075 - RNA, 1701 nt, Artificial Sequence; identical to SEQ ID NO: 63677
  derived and/or modified sequence opt1 from hemagglutinin__InfluenzaA__ADB89691

SEQ ID NO: 65076 - RNA, 1701 nt, Artificial Sequence; identical to SEQ ID NO: 64779
  derived and/or modified sequence opt1 from hemagglutinin__InfluenzaA__ADB89701

SEQ ID NO: 65077 - RNA, 1701 nt, Artificial Sequence
  derived and/or modified sequence opt1 from hemagglutinin__InfluenzaA__ADB89711
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuaccacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 65078 - RNA, 1701 nt, Artificial Sequence
  derived and/or modified sequence opt1 from hemagglutinin__InfluenzaA__ADB89721
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucgacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuaccuguggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccuccugaucaacuccaccgggaaccugaucgccccgcggggcuacuucaagauccagagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 65079 - RNA, 1701 nt, Artificial Sequence
  derived and/or modified sequence opt1 from hemagglutinin__InfluenzaA__ADB90360
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccaacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgccggugcacgacugcaacacgaccugccagacccccaagggggccaucaacaccagccugcccuuccagaacauccaccccaucaccaucggcaagugcccgaaguacgugaaguccaccaagcugcggcucgcgaccgggcugcgcaacauccccagcauccagucccggggccuguucggggccaucgccggcuucaucgagggcggguggacgggcauggucgacgggugguacggcuaccaccaccagaacgagcaggggagcggcuacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacagcaccguggccuccagccugguccucguggugagccugggcgccaucuccuucuggaugugcagcaacggcucccugcagugccggaucugcaucuga

SEQ ID NO: 65080 - RNA, 1701 nt, Artificial Sequence
  derived and/or modified sequence opt1 from hemagglutinin__InfluenzaA__ADB90370
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgccggugcacgacugcaacacgaccugccagacccccaagggggccaucaacaccagccugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65081 - RNA, 1701 nt, Artificial Sequence; identical to SEQ ID NO: 64596
  derived and/or modified sequence opt1 from hemagglutinin__InfluenzaA__ADB90414

SEQ ID NO: 65082 - RNA, 1701 nt, Artificial Sequence; identical to SEQ ID NO: 64124
  derived and/or modified sequence opt1 from hemagglutinin__InfluenzaA__ADC32409

SEQ ID NO: 65083 - RNA, 1701 nt, Artificial Sequence
  derived and/or modified sequence opt1 from hemagglutinin__InfluenzaA__ADC32410
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagaagacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65084 - RNA, 1701 nt, Artificial Sequence
  derived and/or modified sequence opt1 from hemagglutinin__InfluenzaA__ADC32411
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggccaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggcgaagcugaaccgggaggagaucgacggcgugaagcucgaguccacccgcaucuaccagauccuggccaucuacagcaccgucgccagcucccuggugcucguggucagccugggggccaucuccuucuggaugugcagcaacggcucccugcagugccggaucugcaucuga

SEQ ID NO: 65085 - RNA, 1701 nt, Artificial Sequence; identical to SEQ ID NO: 64030
  derived and/or modified sequence opt1 from hemagglutinin__InfluenzaA__ADC32412

SEQ ID NO: 65086 - RNA, 1701 nt, Artificial Sequence; identical to SEQ ID NO: 63677
  derived and/or modified sequence opt1 from hemagglutinin__InfluenzaA__ADC32413

SEQ ID NO: 65087 - RNA, 1701 nt, Artificial Sequence; identical to SEQ ID NO: 64124
  derived and/or modified sequence opt1 from hemagglutinin__InfluenzaA__ADC32414

SEQ ID NO: 65088 - RNA, 1701 nt, Artificial Sequence; identical to SEQ ID NO: 64124
  derived and/or modified sequence opt1 from hemagglutinin__InfluenzaA__ADC32415

SEQ ID NO: 65089 - RNA, 1701 nt, Artificial Sequence; identical to SEQ ID NO: 64124
  derived and/or modified sequence opt1 from hemagglutinin__InfluenzaA__ADC32416

SEQ ID NO: 65090 - RNA, 1701 nt, Artificial Sequence
  derived and/or modified sequence opt1 from hemagglutinin__InfluenzaA__ADC32417
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcaacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65091 - RNA, 1701 nt, Artificial Sequence; identical to SEQ ID NO: 64124
  derived and/or modified sequence opt1 from hemagglutinin__InfluenzaA__ADC32418

SEQ ID NO: 65092 - RNA, 1701 nt, Artificial Sequence
  derived and/or modified sequence opt1 from hemagglutinin__InfluenzaA__ADC32419
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguucggguaccaccaccagaacgaccagggcagcgccuacgccgcggaccucaaguccacccagaacgccaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacagcgaggaggcgaagcugaaccgggaggagaucgacggggugaagcucgaguccacccgcaucuaccagauccuggccaucuacagcaccgucgccagcucccuggugcucguggucagccugggcgccaucuccuucuggaugugcagcaacgggucccugcagugccggaucugcaucuga

SEQ ID NO: 65093 - RNA, 1701 nt, Artificial Sequence; identical to SEQ ID NO: 64124
  derived and/or modified sequence opt1 from hemagglutinin__InfluenzaA__ADC32420

SEQ ID NO: 65094 - RNA, 1701 nt, Artificial Sequence; identical to SEQ ID NO: 64124
  derived and/or modified sequence opt1 from hemagglutinin__InfluenzaA__ADC32421

SEQ ID NO: 65095 - RNA, 1701 nt, Artificial Sequence
  derived and/or modified sequence opt1 from hemagglutinin__InfluenzaA__ADC32422
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucauggugccccgguacgccuucgccauggagcgcaacgccggguccggcaucaucaucagcgacacgcccguccacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 65096 - RNA, 1701 nt, Artificial Sequence
  derived and/or modified sequence opt1 from hemagglutinin__InfluenzaA__ADC32423
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucaacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65097 - RNA, 1701 nt, Artificial Sequence
  derived and/or modified sequence opt1 from hemagglutinin__InfluenzaA__ADC32434
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65098 - RNA, 1701 nt, Artificial Sequence; identical to SEQ ID NO: 65097
  derived and/or modified sequence opt1 from hemagglutinin__InfluenzaA__ADC32435

SEQ ID NO: 65099 - RNA, 1701 nt, Artificial Sequence
  derived and/or modified sequence opt1 from hemagglutinin__InfluenzaA__ADC34940
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagcgcuucaacuggaccggcgugacccagaacgggaccagcuccgccugcaagcggggcagcgacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccugcacgcgcaggccuccggccggaucaccgugagcacgaagcgcucccagcagaccgugaucccgaacaucgggagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugaaguccgacgcccccaucgggaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagagcacccaggcggccaucaaccagaucaacggcaagcugaaccgccugaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaaggggaacauccgcugcaacaucugcaucuga

SEQ ID NO: 65100 - RNA, 1701 nt, Artificial Sequence; identical to SEQ ID NO: 65012
  derived and/or modified sequence opt1 from hemagglutinin__InfluenzaA__ADC38987

SEQ ID NO: 65101 - RNA, 1701 nt, Artificial Sequence
  derived and/or modified sequence opt1 from hemagglutinin__InfluenzaA__ADC38997
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggacgugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65102 - RNA, 1701 nt, Artificial Sequence; identical to SEQ ID NO: 64778
  derived and/or modified sequence opt1 from hemagglutinin__InfluenzaA__ADC39007

SEQ ID NO: 65103 - RNA, 1698 nt, Artificial Sequence
  derived and/or modified sequence opt1 from hemagglutinin__InfluenzaA__ADC45604
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccagcugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcgaccagaaggcccuguaccacaccgagaacgccuacgugagcguggucagcucccacuacagccggaaguucacgcccgagaucgcgaagcgccccaaggugcgggaccaggagggccgcaucaacuacuacuggacccuccuggagcccggggacaccaucaucuucgaggccaacggcaaccugaucgccccgcgguacgccuucgcccucucccgcgggcugggcagcggcaucaucaacuccaacgcgcccauggacaagugcgacgccaagugccagacgccccagggggccaucaacagcucccugcccuuccagaacgugcacccggucaccaucggcgagugccccaaguacgugcggagcgccaagcuccgcauggugaccgggcugcggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcucgagcggcgcauggagaaccugaacaagaagguggacgacggcuucaucgacaucuggaccuacaacgcggagcugcucguccugcuggagaacgagcggacgcucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 65104 - RNA, 1698 nt, Artificial Sequence
  derived and/or modified sequence opt1 from hemagglutinin__InfluenzaA__ADC45626
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccagcggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 65105 - RNA, 1698 nt, Artificial Sequence
  derived and/or modified sequence opt1 from hemagglutinin__InfluenzaA__ADC45637
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccagcggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 65106 - RNA, 1698 nt, Artificial Sequence
  derived and/or modified sequence opt1 from hemagglutinin__InfluenzaA__ADC45648
augaaggugaagcugcucguccugcugugcaccuucgccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccaucgccggcuggguccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacccccgagaucgcgaagcgccccaaggugcgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuucaucgacaucuggaccuacaacgcggagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 65107 - RNA, 1698 nt, Artificial Sequence
  derived and/or modified sequence opt1 from hemagglutinin__InfluenzaA__ADC45659
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaagaaguccagcuggcccaaccacacggucaccggcguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaucggggaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacagcaccguggccagcucccuggugcuccuggucagccugggcgccaucuccuucuggaugugcagcaacgggucccuccagugccggaucugcaucuga

SEQ ID NO: 65108 - RNA, 1698 nt, Artificial Sequence
  derived and/or modified sequence opt1 from hemagglutinin__InfluenzaA__ADC45670
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggggcuccgccagcugcucccacaacggggagagcuccuucuaccgcaaccugcuguggcucaccggcaagaacgggcuguaccccaaccugagcaaguccuacgccaacaacaaggagaaggaggugcucgugcuguggggcguccaccacccgcccaacaucggcgaccagaaggcccuguaccacaccgagaacgccuacgugagcguggucagcucccacuacagccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacgugcacccggucaccaucggggagugccccaaguacgugcggagcgccaagcugcgcauggugaccggccuccggaacauccccuccauccagagccgcgggcuguucggcgccaucgccggcuucaucgagggcggcuggaccgggauggucgacggcugguacggguaccaccaccagaacgagcagggcuccggcuacgcggccgaccagaaguccacccagaacgccaucaacgggaucacgaacaaggugaacagcgugaucgagaagaugaacacccaguucaccgccgucggcaaggaguucaacaagcuggagcggcgcauggagaaccucaacaagaagguggacgacggguucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgcgagaagaucgacggcgugaagcucgaguccauggggguguaccagauccuggccaucuacagcaccgucgccagcucccuggugcuccuggugagccugggcgccaucuccuucuggaugugcagcaacgggucccuccagugccggaucugcaucuga

SEQ ID NO: 65109 - RNA, 1698 nt, Artificial Sequence
  derived and/or modified sequence opt1 from hemagglutinin__InfluenzaA__ADC45681
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgccagcuccuucgagcgguucgagaucuucccgaaggagagcuccuggcccaaccacacggugaccggggucagcgccuccugcagccacaacggcgaguccagcuucuacaagaaccugcuguggcucaccgggaagaacggccuguaccccaaccugcgcaaguccuacgccaacaacaaggagaaggaggugcucgugcuguggggcguccaccacccgcccaacaucggcgaccagaugacccuguaccacaaggagaacgccuacgugagcguggucuccagccacuacagccggaaguucacgcccgagaucgccaagcgccccaaggugcgggaccaggagggccgcaucaacuacuacuggacccuccuggagcccggggacaccaucaucuucgaggcguccggcaaccugaucgccccgcgguacgccuucgcccucagccgcggguucggcuccggcaucaucaacagcaacgcccccauggacgagugcgacgcgaagugccagacgccccagggggccaucaacuccagccugcccuuccagaacgugcacccggucaccaucggcgagugccccaaguacgugcgguccgccaagcugcgcauggugaccgggcuccggaacauccccagcauccagucccgcggccuguucggggccaucgccggcuucaucgagggcggguggaccggcauggucgacgggugguacggcuaccaccaccagaacgagcaggggagcggcuacgcggccgaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuucaucgacgucuggaccuacaacgccgagcugcuggugcuccuggagaacgagcggacgcuggacuuccacgacuccaacgugaagaaccucuacgagaaggucaagaaccagcugaagaacaacgcgaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgugaagcucgagagcaugggcgucuaccagauccuggccaucuacuccaccguggccagcagccuggugcuccuggucucccugggggccaucagcuucuggaugugcuccaacggcagccuccagugccggaucugcaucuga

SEQ ID NO: 65110 - RNA, 1698 nt, Artificial Sequence
  derived and/or modified sequence opt1 from hemagglutinin__InfluenzaA__ADC45692
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaagaaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 65111 - RNA, 1698 nt, Artificial Sequence; identical to SEQ ID NO: 64178
  derived and/or modified sequence opt1 from hemagglutinin__InfluenzaA__ADC45703

SEQ ID NO: 65112 - RNA, 1698 nt, Artificial Sequence
  derived and/or modified sequence opt1 from hemagglutinin__InfluenzaA__ADC45714
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaccacgcuguaccacaaggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccagcggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacguguggacguacaacgccgagcugcuggugcuccuggagaacgagcgcacccuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 65113 - RNA, 1698 nt, Artificial Sequence; identical to SEQ ID NO: 64178
  derived and/or modified sequence opt1 from hemagglutinin__InfluenzaA__ADC45725

SEQ ID NO: 65114 - RNA, 1698 nt, Artificial Sequence
  derived and/or modified sequence opt1 from hemagglutinin__InfluenzaA__ADC45736
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacacguacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcaucuga

SEQ ID NO: 65115 - RNA, 1698 nt, Artificial Sequence; identical to SEQ ID NO: 63496
  derived and/or modified sequence opt1 from hemagglutinin__InfluenzaA__ADC45747

SEQ ID NO: 65116 - RNA, 1698 nt, Artificial Sequence
  derived and/or modified sequence opt1 from hemagglutinin__InfluenzaA__ADC45758
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccugaacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccagcagccuggugcuccuggucucccugggcgccaucagcuucuggaugugcuccaacgggagccuccagugccggaucugcaucuga

SEQ ID NO: 65117 - RNA, 1698 nt, Artificial Sequence; identical to SEQ ID NO: 64634
  derived and/or modified sequence opt1 from hemagglutinin__InfluenzaA__ADC45780

SEQ ID NO: 65118 - RNA, 1698 nt, Artificial Sequence; identical to SEQ ID NO: 64139
  derived and/or modified sequence opt1 from hemagglutinin__InfluenzaA__ADC45791

SEQ ID NO: 65119 - RNA, 1698 nt, Artificial Sequence
  derived and/or modified sequence opt1 from hemagglutinin__InfluenzaA__ADC45813
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggcgucuccgccagcugcucccacaacggcgagagcuccuucuaccgcaaccugcuguggcucaccaugaagaacgggcuguaccccaaccugagcaaguccuacgccaacaacaaggagaaggaggugcucgugcuguggggcguccaccacccgcccaacaucggggaccagaagacccuguacaacacggagaacgccuacgugagcguggucagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggucaccaucggggagugccccaaguacgugcggagcgccaagcugcgcauggugaccggccuccggaacauccccuccauccagagccgcgggcuguucggcgccaucgccggguucaucgagggcggcuggaccgggauggucgacggcugguacggguaccaccaccagaacgagcagggcuccggguacgccgcggaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagagcaagcugaaccgcgagaagaucgacggggugaagcucgaguccaugggcguguaccagauccuggcgaucuacagcaccgucgccagcucccuggugcuccuggugagccugggcgccaucuccuucuggaugugcagcaacgggucccuccagugccggaucugcaucuga

SEQ ID NO: 65120 - RNA, 1698 nt, Artificial Sequence; identical to SEQ ID NO: 64139
  derived and/or modified sequence opt1 from hemagglutinin__InfluenzaA__ADC45824

SEQ ID NO: 65121 - RNA, 1698 nt, Artificial Sequence
  derived and/or modified sequence opt1 from hemagglutinin__InfluenzaA__ADC45835
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugacccucgagagcaugggcgucuaccagauccuggccaucuacuccacgguggccagcagccuggugcuccuggucucccugggcgccaucagcuucuggaugugcuccaacgggagccuccagugccggaucugcaucuga

SEQ ID NO: 65122 - RNA, 1698 nt, Artificial Sequence; identical to SEQ ID NO: 63496
  derived and/or modified sequence opt1 from hemagglutinin__InfluenzaA__ADC45846

SEQ ID NO: 65123 - RNA, 1701 nt, Artificial Sequence; identical to SEQ ID NO: 63677
  derived and/or modified sequence opt1 from hemagglutinin__InfluenzaA__ADC53558

SEQ ID NO: 65124 - RNA, 1701 nt, Artificial Sequence; identical to SEQ ID NO: 63768
  derived and/or modified sequence opt1 from hemagglutinin__InfluenzaA__ADD14087

SEQ ID NO: 65125 - RNA, 1701 nt, Artificial Sequence; identical to SEQ ID NO: 63677
  derived and/or modified sequence opt1 from hemagglutinin__InfluenzaA__ADD14089

SEQ ID NO: 65126 - RNA, 1701 nt, Artificial Sequence; identical to SEQ ID NO: 63677
  derived and/or modified sequence opt1 from hemagglutinin__InfluenzaA__ADD14093

SEQ ID NO: 65127 - RNA, 1701 nt, Artificial Sequence
  derived and/or modified sequence opt1 from hemagglutinin__InfluenzaA__ADD14095
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucgugcugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65128 - RNA, 1701 nt, Artificial Sequence; identical to SEQ ID NO: 63677
  derived and/or modified sequence opt1 from hemagglutinin__InfluenzaA__ADD14097

SEQ ID NO: 65129 - RNA, 1701 nt, Artificial Sequence; identical to SEQ ID NO: 63677
  derived and/or modified sequence opt1 from hemagglutinin__InfluenzaA__ADD14099

SEQ ID NO: 65130 - RNA, 1701 nt, Artificial Sequence; identical to SEQ ID NO: 63677
  derived and/or modified sequence opt1 from hemagglutinin__InfluenzaA__ADD14101

SEQ ID NO: 65131 - RNA, 1701 nt, Artificial Sequence
  derived and/or modified sequence opt1 from hemagglutinin__InfluenzaA__ADD14103
augaaggccauccuggugguccuccugugcaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggacaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65132 - RNA, 1701 nt, Artificial Sequence
  derived and/or modified sequence opt1 from hemagglutinin__InfluenzaA__ADD14111
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaucuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65133 - RNA, 1701 nt, Artificial Sequence; identical to SEQ ID NO: 63677
  derived and/or modified sequence opt1 from hemagglutinin__InfluenzaA__ADD14115

SEQ ID NO: 65134 - RNA, 1701 nt, Artificial Sequence; identical to SEQ ID NO: 63677
  derived and/or modified sequence opt1 from hemagglutinin__InfluenzaA__ADD14117

SEQ ID NO: 65135 - RNA, 1701 nt, Artificial Sequence; identical to SEQ ID NO: 63677
  derived and/or modified sequence opt1 from hemagglutinin__InfluenzaA__ADD14119

SEQ ID NO: 65136 - RNA, 1701 nt, Artificial Sequence; identical to SEQ ID NO: 63677
  derived and/or modified sequence opt1 from hemagglutinin__InfluenzaA__ADD14121

SEQ ID NO: 65137 - RNA, 1701 nt, Artificial Sequence; identical to SEQ ID NO: 63677
  derived and/or modified sequence opt1 from hemagglutinin__InfluenzaA__ADD14123

SEQ ID NO: 65138 - RNA, 1701 nt, Artificial Sequence; identical to SEQ ID NO: 63677
  derived and/or modified sequence opt1 from hemagglutinin__InfluenzaA__ADD14127

SEQ ID NO: 65139 - RNA, 1701 nt, Artificial Sequence
  derived and/or modified sequence opt1 from hemagglutinin__InfluenzaA__ADD14129
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgccagccugcaccucgggaagugcaacaucgccggcuggauccuggggaaccccgagugcgagucccugagcaccgcguccagcugguccuacaucguggagaccagcuccagcgacaacggcacgugcuacccgggcgacuucaucgacuacgaggagcuccgggagcagcuguccagcguguccagcuucgagcgcuucgagaucuuccccaagaccuccagcuggcccaaccacgacuccaacaagggggucaccgccgccugcccccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgcggaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65140 - RNA, 1701 nt, Artificial Sequence
  derived and/or modified sequence opt1 from hemagglutinin__InfluenzaA__ADD14133
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacguggacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguucggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcugcggcucgccaccggccugcgcaacgugccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggucaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcguccagccuggugcucgucgugagccugggggccaucuccuucuggaugugcagcaacggcucccugcagugccggaucugcaucuga

SEQ ID NO: 65141 - RNA, 1701 nt, Artificial Sequence; identical to SEQ ID NO: 63768
  derived and/or modified sequence opt1 from hemagglutinin__InfluenzaA__ADD14135

SEQ ID NO: 65142 - RNA, 1701 nt, Artificial Sequence; identical to SEQ ID NO: 63677
  derived and/or modified sequence opt1 from hemagglutinin__InfluenzaA__ADD14137

SEQ ID NO: 65143 - RNA, 1701 nt, Artificial Sequence; identical to SEQ ID NO: 64425
  derived and/or modified sequence opt1 from hemagglutinin__InfluenzaA__ADD14139

SEQ ID NO: 65144 - RNA, 1701 nt, Artificial Sequence; identical to SEQ ID NO: 63677
  derived and/or modified sequence opt1 from hemagglutinin__InfluenzaA__ADD14143

SEQ ID NO: 65145 - RNA, 1701 nt, Artificial Sequence; identical to SEQ ID NO: 63677
  derived and/or modified sequence opt1 from hemagglutinin__InfluenzaA__ADD14145

SEQ ID NO: 65146 - RNA, 1701 nt, Artificial Sequence; identical to SEQ ID NO: 63677
  derived and/or modified sequence opt1 from hemagglutinin__InfluenzaA__ADD14147

SEQ ID NO: 65147 - RNA, 1701 nt, Artificial Sequence
  derived and/or modified sequence opt1 from hemagglutinin__InfluenzaA__ADD14151
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcgggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65148 - RNA, 1701 nt, Artificial Sequence; identical to SEQ ID NO: 63677
  derived and/or modified sequence opt1 from hemagglutinin__InfluenzaA__ADD14153

SEQ ID NO: 65149 - RNA, 1701 nt, Artificial Sequence; identical to SEQ ID NO: 63677
  derived and/or modified sequence opt1 from hemagglutinin__InfluenzaA__ADD14155

SEQ ID NO: 65150 - RNA, 1701 nt, Artificial Sequence; identical to SEQ ID NO: 63677
  derived and/or modified sequence opt1 from hemagglutinin__InfluenzaA__ADD14157

SEQ ID NO: 65151 - RNA, 1701 nt, Artificial Sequence; identical to SEQ ID NO: 63677
  derived and/or modified sequence opt1 from hemagglutinin__InfluenzaA__ADD14162

SEQ ID NO: 65152 - RNA, 1701 nt, Artificial Sequence; identical to SEQ ID NO: 63677
  derived and/or modified sequence opt1 from hemagglutinin__InfluenzaA__ADD14172

SEQ ID NO: 65153 - RNA, 1701 nt, Artificial Sequence; identical to SEQ ID NO: 63677
  derived and/or modified sequence opt1 from hemagglutinin__InfluenzaA__ADD14182

SEQ ID NO: 65154 - RNA, 1701 nt, Artificial Sequence; identical to SEQ ID NO: 63677
  derived and/or modified sequence opt1 from hemagglutinin__InfluenzaA__ADD14192

SEQ ID NO: 65155 - RNA, 1701 nt, Artificial Sequence; identical to SEQ ID NO: 63677
  derived and/or modified sequence opt1 from hemagglutinin__InfluenzaA__ADD14202

SEQ ID NO: 65156 - RNA, 1701 nt, Artificial Sequence
  derived and/or modified sequence opt1 from hemagglutinin__InfluenzaA__ADD21447
augaaggccauccugguguuccuccuguacaccuucgccaccgcgaacgccgacacgcugugcaucggcuaccacgccaacaacagcaccgacaccgucgacaccgugcucgagaagaacgugacggucacccacuccgugaaccugcuggaggaccgccacaacgggaagcucugcaagcugcggggcguggcgccccugcaccucgggaagugcaacaucgccggcuggcugcuggggaacccggagugcgagcuccuguucaccgccagcuccuggagcuacaucgucgagaccuccaacagcgacaacggcacgugcuaccccggcgacuucaucaacuacgaggagcugcgcgagcagcucuccagcguguccagcuucgagcgguucgagauguuccccaaguccagcuccuggcccaaccacgagaccaaccgcggggugaccgccgccugcccguacgccggcgcgaacagcuucuaccggaaccugaucuggcuggucaagaaggagaacuccuaccccaagcucagcaaguccuacaucaacaacaaggagaaggaggugcuggugcugugggggauccaccacccgcccaccagcgccgaccagcagucccucuaccagaacgccgacgccuacgucuucgugggcagcagcaaguacaacaagaaguuccgccccgagaucgccgcgcggcccaaggugcgcgggcagacgggccggaugaacuacuacuggacccuggucgagcccggcgacaccaucaccuucgaggccacggagaaccugguggugccccgcuacgccuucgccaugaagcggggguccggcagcgggaucaucaucuccgacaccccgguccacgacugcaacacgaccugccagacccccaagggcgccaucaacaccagccuccccuuccagaacauccaccccgugaccaucggcgagugcccgaaguacgugaaguccaccaaccugcgcauggcgacggggcugcggaacauccccagcauccagucccgcggccucuucggggccaucgccggcuucaucgagggcggguggaccggcaugaucgacgggugguacggcuaccaccaccagaacgagcaggggagcggcuacgccgccgaccggaaguccacccagaacgcgaucgacgggaucaccaacaaggucaacagcgugaucgagaagaugaacacgcaguucaccgccgugggcaaggaguucaaccaccuggagaagcgcaucgagaaccugaacaagaaggucgacgacggccuccuggacguguggaccuacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacgacacgugcauggaguccguccggaacggggccuacgacuaccccaaguacagcgaggaggcgaagcucaaccgcgaggagaucgacggcgugaagcuggaguccacccggaucuaccagauccuggccaucuacagcaccguggccuccagccucguccugcuggugucccucggggccaucagcuucuggaugugcagcaacggcucccugcagugccgcaucugcaucuga

SEQ ID NO: 65157 - RNA, 1701 nt, Artificial Sequence
  derived and/or modified sequence opt1 from hemagglutinin__InfluenzaA__ADD21457
augaaggccauccugguguuccuccuguacaccuucgccaccgcgaacgccgacacgcugugcaucggcuaccacgccaacaacagcaccgacaccgucgacaccgugcucgagaagaacgugacggucacccacuccgugaaccugcuggaggaccgccacaacgggaagcucugcaagcugcggggcguggcgccccugcaccucgggaagugcaacaucgccggcuggcugcuggggaacccggagugcgagcuccuguucaccgccagcuccuggagcuacaucgucgagaccuccaacagcgacaacggcacgugcuaccccggcgacuucaucaacuacgaggagcugcgcgagcagcucuccagcguguccagcuucgagcgguucgagauguuccccaaguccagcuccuggcccaaccacgagaccaaccgcggggugaccgccgccugcccguacgccggcgcgaacagcuucuaccggaaccugaucuggcuggucaagaaggagaacuccuaccccaagcucagcaaguccuacaucaacaacaaggagaaggaggugcuggugcugugggggauccaccacccgcccaccagcgccgaccagcagucccucuaccagaacgccgacgccuacgucuucgugggcagcagcaaguacaacaagaaguuccgccccgagaucgccgcgcggcccaaggugcgcgggcagacgggccggaugaacuacuacuggacccuggucgagcccggcgacaccaucaccuucgaggccacggggaaccugguggugccccgcuacgccuucgccaugaagcggggcuccgggagcggcaucaucaucuccgacaccccgguccacgacugcaacacgaccugccagacccccaagggcgccgugaacaccagccuccccuuccagaacauccaccccgugaccaucggggagugcccgaaguacgucaaguccaccaaccugcgcauggcgacgggccugcggaacauccccagcauccagucccgcggccucuucggggccaucgccggguucaucgagggcggcuggaccgggaugaucgacggcugguacggguaccaccaccagaacgagcagggcagcggguacgccgccgaccggaaguccacccagaacgcgaucgacggcaucaccaacaaggugaacagcgugaucgagaagaugaacacgcaguucaccgccgucggcaaggaguucaaccaccuggagaagcgcaucgagaaccugaacaagaagguggacgacgggcuccuggacgucuggaccuacaacgccgagcugcucgugcugcuggagaacgagcggacccucgacuaccacgacuccaacgugaagaaccuguacgagaagguccgcagccagcugaagaacaacgccaaggagaucggcaacgggugcuucgaguucuaccacaagugcgacgacacgugcauggaguccgugcggaacggcaccuacgacuaccccaaguacagcgaggaggccaagcucaaccgcgaggagaucgacggggugaagcuggaguccacccggaucuaccagauccuggcgaucuacagcaccgucgccuccagccucgugcugcuggugucccucggcgccaucagcuucuggaugugcagcaacggcucccugcagugccgcaucugcaucuga

SEQ ID NO: 65158 - RNA, 1698 nt, Artificial Sequence
  derived and/or modified sequence opt1 from hemagglutinin__InfluenzaA__ADD21467
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacauccgggaccagcgcgcccuguaccacacggagaacgccuacgugagcguggucagcucccacuacagccggcgcuucacccccgagaucgcgaagcggcccaaggugcgcgggcaggagggccggaucaacuacuacuggacccuccuggagcccggggacaccaucaucuucgaggccaacggcaaccugaucgccccgugguacgccuucgcccucucccgcggguucggcagcggcaucaucacguccaacgcgcccauggacgagugcgacgccaagugccagacgccccagggggccaucaacagcucccugcccuuccagaacgugcacccggucaccaucggcgagugccccaaguacgcccggagcgccaagcugcgcauggugaccgggcuccggaacauccccuccauccagagccgcggccuguucggggcgaucgccggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacccaguucacggcgguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgucaagcuggaguccaugggcguguaccagauccuggccaucuacagcacgguggccagcucccucguccugcuggugagccucggggcgaucuccuucuggaugugcagcaacggcucccugcagugccggaucugcaucuga

SEQ ID NO: 65159 - RNA, 1701 nt, Artificial Sequence
  derived and/or modified sequence opt1 from hemagglutinin__InfluenzaA__ADD21560
augaagaccaucaucgccuucagccacauccugugccucaucuacgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacagcccccaccacauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgucccugcgcagccucguggccuccagcggcacgcuggaguucacccaggaguccuucaacuggaccggcgucacccaggacgggagcuccuacacgugccggcgcaagagcgugaacuccuucuucagccggcugaacuggcuccacaaccuggacuacaaguaccccgcccugaacgugaccaugcccaacaacgacaaguucgacaagcucuacaucuggggcguccaccaccccgggaccgaccgcgaccagaccaaccuguacgugcaggccuccggccgggugacggucagcaccaagcgcagccagcagaccgugaucccgaacaucgggucccggcccugggugcgcggcgucagcuccaucaucagcaucuacuggaccaucgugaagcccggcgacauccugcucaucaacuccacggggaaccugaucgcgccccggggcuacuucaagauccagagcgggaaguccagcaucaugcgcuccgacgccccgaucggcaacugcaacagcgagugcaucacccccaacggcuccauccccaacgacaagcccuuccagaacgugaaccggaucaccuacggggccugcccgcgcuacgucaagcagaacacccugaagcucgccacgggcaugcggaacgugcccgagaagcagacccgcgggaucuucggcgccaucgcgggguucaucgagaacggcugggagggcaugguggacgggugguacggcuuccggcaccagaacagcgaggggaccggccaggccgccgaccugaaguccacccaggccgccaucaaccagaucacggggaagcugaaccgcgucaucaagaagaccaacgagaaguuccaccagaucgagaaggaguucagcgagguggagggccggauccaggaccucgagaaguacguggaggacaccaagaucgaccugugguccuacaacgcggagcugcucgucgcccuggagaaccagcacaccaucgaccugacggacagcgagaugaacaagcuguucgagcgcacccggaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagagcguccagcucaaguccggcuacaaggacuggauccuguggaucagcuucgcgaugagcugcuuccugcucugcguggugcugcugggguucaucauguggaccugccagaagggcaacaucaagugcaacaucugcaucuga

SEQ ID NO: 65160 - RNA, 1701 nt, Artificial Sequence; identical to SEQ ID NO: 63664
  derived and/or modified sequence opt1 from hemagglutinin__InfluenzaA__ADD21734

SEQ ID NO: 65161 - RNA, 1701 nt, Artificial Sequence; identical to SEQ ID NO: 63677
  derived and/or modified sequence opt1 from hemagglutinin__InfluenzaA__ADD21744

SEQ ID NO: 65162 - RNA, 1701 nt, Artificial Sequence
  derived and/or modified sequence opt1 from hemagglutinin__InfluenzaA__ADD21764
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65163 - RNA, 1701 nt, Artificial Sequence
  derived and/or modified sequence opt1 from hemagglutinin__InfluenzaA__ADD21774
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcgugcagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 65164 - RNA, 1701 nt, Artificial Sequence; identical to SEQ ID NO: 63677
  derived and/or modified sequence opt1 from hemagglutinin__InfluenzaA__ADD21784

SEQ ID NO: 65165 - RNA, 1701 nt, Artificial Sequence; identical to SEQ ID NO: 64837
  derived and/or modified sequence opt1 from hemagglutinin__InfluenzaA__ADD21794

SEQ ID NO: 65166 - RNA, 1701 nt, Artificial Sequence; identical to SEQ ID NO: 63677
  derived and/or modified sequence opt1 from hemagglutinin__InfluenzaA__ADD21804

SEQ ID NO: 65167 - RNA, 1701 nt, Artificial Sequence
  derived and/or modified sequence opt1 from hemagglutinin__InfluenzaA__ADD21814
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccagcuggauccugggcaacccggagugcgagucccugagcaccgcguccagcugguccuacaucguggagaccagcuccagcgacaacgggacgugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaagagcuacaucaacgacaaggggaaggaggugcugguccucuggggcauccaccaccccuccaccagcgccgaccagcagucccuguaccagaacgccgacgccuacguguucguggggacgagccgguacuccaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcagcgggaucaucaucuccgacacgcccgugcacgacugcaacacgaccugccagaccccgaagggcgccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacgggucccugcagugccggaucugcaucuga

SEQ ID NO: 65168 - RNA, 1701 nt, Artificial Sequence; identical to SEQ ID NO: 64837
  derived and/or modified sequence opt1 from hemagglutinin__InfluenzaA__ADD21824

SEQ ID NO: 65169 - RNA, 1701 nt, Artificial Sequence; identical to SEQ ID NO: 64837
  derived and/or modified sequence opt1 from hemagglutinin__InfluenzaA__ADD21834

SEQ ID NO: 65170 - RNA, 1701 nt, Artificial Sequence; identical to SEQ ID NO: 64841
  derived and/or modified sequence opt1 from hemagglutinin__InfluenzaA__ADD21844

SEQ ID NO: 65171 - RNA, 1701 nt, Artificial Sequence; identical to SEQ ID NO: 64841
  derived and/or modified sequence opt1 from hemagglutinin__InfluenzaA__ADD21854

SEQ ID NO: 65172 - RNA, 1701 nt, Artificial Sequence; identical to SEQ ID NO: 64779
  derived and/or modified sequence opt1 from hemagglutinin__InfluenzaA__ADD21864

SEQ ID NO: 65173 - RNA, 1701 nt, Artificial Sequence
  derived and/or modified sequence opt1 from hemagglutinin__InfluenzaA__ADD21884
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcaugggcagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65174 - RNA, 1701 nt, Artificial Sequence; identical to SEQ ID NO: 64779
  derived and/or modified sequence opt1 from hemagglutinin__InfluenzaA__ADD21894

SEQ ID NO: 65175 - RNA, 1701 nt, Artificial Sequence
  derived and/or modified sequence opt1 from hemagglutinin__InfluenzaA__ADD22501
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacagcaacgugaagaaccucuacgagaaggugcggauccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcucgaguccacccggaucuaccagauccuggcgaucuacagcaccguggccuccagccugguccucguggugagccugggggccaucuccuucuggaugugcagcaacggcucccugcagugccgcaucugcaucuga

SEQ ID NO: 65176 - RNA, 1701 nt, Artificial Sequence; identical to SEQ ID NO: 64779
  derived and/or modified sequence opt1 from hemagglutinin__InfluenzaA__ADD22511

SEQ ID NO: 65177 - RNA, 1701 nt, Artificial Sequence
  derived and/or modified sequence opt1 from hemagglutinin__InfluenzaA__ADD22521
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 65178 - RNA, 1701 nt, Artificial Sequence; identical to SEQ ID NO: 63677
  derived and/or modified sequence opt1 from hemagglutinin__InfluenzaA__ADD22531

SEQ ID NO: 65179 - RNA, 1701 nt, Artificial Sequence
  derived and/or modified sequence opt1 from hemagglutinin__InfluenzaA__ADD22541
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacguccaaguacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 65180 - RNA, 1701 nt, Artificial Sequence; identical to SEQ ID NO: 64779
  derived and/or modified sequence opt1 from hemagglutinin__InfluenzaA__ADD22554

SEQ ID NO: 65181 - RNA, 1701 nt, Artificial Sequence; identical to SEQ ID NO: 64779
  derived and/or modified sequence opt1 from hemagglutinin__InfluenzaA__ADD22564

SEQ ID NO: 65182 - RNA, 1701 nt, Artificial Sequence
  derived and/or modified sequence opt1 from hemagglutinin__InfluenzaA__ADD22574
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagacccugaagggcgccaucaacaccucccugccguuccagaacauccaccccaucaccaucgggaagugccccaaguacgucaagagcaccaagcuccggcuggccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccucaacaagaagaucgacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagagcacccgcaucuaccagauccuggccaucuacuccaccguggcgagcagccucguccugguggugucccugggggccaucagcuucuggaugugcuccaacggcagccuccagugccggaucugcaucuga

SEQ ID NO: 65183 - RNA, 1701 nt, Artificial Sequence; identical to SEQ ID NO: 64779
  derived and/or modified sequence opt1 from hemagglutinin__InfluenzaA__ADD22584

SEQ ID NO: 65184 - RNA, 1701 nt, Artificial Sequence; identical to SEQ ID NO: 63677
  derived and/or modified sequence opt1 from hemagglutinin__InfluenzaA__ADD22594

SEQ ID NO: 65185 - RNA, 1701 nt, Artificial Sequence; identical to SEQ ID NO: 64779
  derived and/or modified sequence opt1 from hemagglutinin__InfluenzaA__ADD22604

SEQ ID NO: 65186 - RNA, 1701 nt, Artificial Sequence; identical to SEQ ID NO: 64779
  derived and/or modified sequence opt1 from hemagglutinin__InfluenzaA__ADD22614

SEQ ID NO: 65187 - RNA, 1701 nt, Artificial Sequence; identical to SEQ ID NO: 64779
  derived and/or modified sequence opt1 from hemagglutinin__InfluenzaA__ADD22624

SEQ ID NO: 65188 - RNA, 1701 nt, Artificial Sequence
  derived and/or modified sequence opt1 from hemagglutinin__InfluenzaA__ADD22634
augaaggccauccuggugguccuccugugcaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65189 - RNA, 1701 nt, Artificial Sequence
  derived and/or modified sequence opt1 from hemagglutinin__InfluenzaA__ADD22645
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgagggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 65190 - RNA, 1701 nt, Artificial Sequence
  derived and/or modified sequence opt1 from hemagglutinin__InfluenzaA__ADD22665
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaagcggaaggaggugcugguccucugggggauccaccaccccagcaccuccgccgaccagcagagccuguaccagaacgccgacgccuacguguucgugggcacguccaaguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65191 - RNA, 1701 nt, Artificial Sequence; identical to SEQ ID NO: 64779
  derived and/or modified sequence opt1 from hemagglutinin__InfluenzaA__ADD22675

SEQ ID NO: 65192 - RNA, 1701 nt, Artificial Sequence; identical to SEQ ID NO: 64779
  derived and/or modified sequence opt1 from hemagglutinin__InfluenzaA__ADD22685

SEQ ID NO: 65193 - RNA, 1701 nt, Artificial Sequence; identical to SEQ ID NO: 64779
  derived and/or modified sequence opt1 from hemagglutinin__InfluenzaA__ADD22695

SEQ ID NO: 65194 - RNA, 1701 nt, Artificial Sequence
  derived and/or modified sequence opt1 from hemagglutinin__InfluenzaA__ADD22722
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggaccgccacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacguccagcuacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 65195 - RNA, 1701 nt, Artificial Sequence; identical to SEQ ID NO: 65177
  derived and/or modified sequence opt1 from hemagglutinin__InfluenzaA__ADD22732

SEQ ID NO: 65196 - RNA, 1701 nt, Artificial Sequence
  derived and/or modified sequence opt1 from hemagglutinin__InfluenzaA__ADD22742
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacguccagcuacuccaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcgccucgcgaccgggcugcggaacgucccgagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacggcucccugcagugccgcaucugcaucuga

SEQ ID NO: 65197 - RNA, 1701 nt, Artificial Sequence; identical to SEQ ID NO: 63677
  derived and/or modified sequence opt1 from hemagglutinin__InfluenzaA__ADD22752

SEQ ID NO: 65198 - RNA, 1701 nt, Artificial Sequence; identical to SEQ ID NO: 63768
  derived and/or modified sequence opt1 from hemagglutinin__InfluenzaA__ADD22762

SEQ ID NO: 65199 - RNA, 1701 nt, Artificial Sequence; identical to SEQ ID NO: 64779
  derived and/or modified sequence opt1 from hemagglutinin__InfluenzaA__ADD22772

SEQ ID NO: 65200 - RNA, 1701 nt, Artificial Sequence; identical to SEQ ID NO: 64779
  derived and/or modified sequence opt1 from hemagglutinin__InfluenzaA__ADD22782

SEQ ID NO: 65201 - RNA, 1701 nt, Artificial Sequence
  derived and/or modified sequence opt1 from hemagglutinin__InfluenzaA__ADD22792
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 65202 - RNA, 1701 nt, Artificial Sequence; identical to SEQ ID NO: 65177
  derived and/or modified sequence opt1 from hemagglutinin__InfluenzaA__ADD22802

SEQ ID NO: 65203 - RNA, 1701 nt, Artificial Sequence; identical to SEQ ID NO: 64779
  derived and/or modified sequence opt1 from hemagglutinin__InfluenzaA__ADD22812

SEQ ID NO: 65204 - RNA, 1701 nt, Artificial Sequence
  derived and/or modified sequence opt1 from hemagglutinin__InfluenzaA__ADD22822
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcgccgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgcgggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcaaguacuccaagaaguucaagcccgagaucgcgauccggccgaagguccgcgaccaggagggccggaugaacuacuacuggacccugguggagcccggggacaagaucaccuucgaggccaccggcaaccucguggucccccgcuacgccuucgccauggagcggaacgccgggagcggcaucaucaucuccgacacgcccgugcacgacugcaacacgaccugccagaccccgaagggcgcgaucaacaccagccugcccuuccagaacauccaccccaucaccaucgggaagugccccaaguacgugaaguccaccaagcugcgccucgccaccggccugcggaacgucccgagcauccagucccgcgggcuguucggcgccaucgccggguucaucgagggcggcuggacggggaugguggacggcugguacggguaccaccaccagaacgagcagggcagcggguacgccgcggaccucaaguccacccagaacgccaucgacgagaucaccaacaaggugaacagcgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacuccaacgugaagaaccucuacgagaaggugcggagccagcugaagaacaacgccaaggagaucgggaacggcugcuucgaguucuaccacaagugcgacaacaugugcauggaguccgucaagaacgggaccuacgacuaccccaaguacagcgaggaggcgaagcugaaccgcgaggagaucgacggcgugaagcucgaguccacgcggaucuaccagauccuggccaucuacagcaccguggccuccagccugguccucguggugagccugggggccaucuccuucuggaugugcagcaacggcucccugcagugccgcaucugcaucuga

SEQ ID NO: 65205 - RNA, 1701 nt, Artificial Sequence; identical to SEQ ID NO: 64779
  derived and/or modified sequence opt1 from hemagglutinin__InfluenzaA__ADD22832

SEQ ID NO: 65206 - RNA, 1701 nt, Artificial Sequence; identical to SEQ ID NO: 64779
  derived and/or modified sequence opt1 from hemagglutinin__InfluenzaA__ADD22842

SEQ ID NO: 65207 - RNA, 1701 nt, Artificial Sequence
  derived and/or modified sequence opt1 from hemagglutinin__InfluenzaA__ADD22852
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65208 - RNA, 1701 nt, Artificial Sequence
  derived and/or modified sequence opt1 from hemagglutinin__InfluenzaA__ADD22941
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucagcugguccuacaucguggagaccagcuccagcggcaacggcacgugcuaccccggggacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65209 - RNA, 1701 nt, Artificial Sequence; identical to SEQ ID NO: 64779
  derived and/or modified sequence opt1 from hemagglutinin__InfluenzaA__ADD22951

SEQ ID NO: 65210 - RNA, 1701 nt, Artificial Sequence; identical to SEQ ID NO: 64779
  derived and/or modified sequence opt1 from hemagglutinin__InfluenzaA__ADD22961

SEQ ID NO: 65211 - RNA, 1701 nt, Artificial Sequence; identical to SEQ ID NO: 64779
  derived and/or modified sequence opt1 from hemagglutinin__InfluenzaA__ADD22971

SEQ ID NO: 65212 - RNA, 1701 nt, Artificial Sequence; identical to SEQ ID NO: 64779
  derived and/or modified sequence opt1 from hemagglutinin__InfluenzaA__ADD23072

SEQ ID NO: 65213 - RNA, 1701 nt, Artificial Sequence
  derived and/or modified sequence opt1 from hemagglutinin__InfluenzaA__ADD23082
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacacguacguguucgugggcaccucccgguacagcaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagagcaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 65214 - RNA, 1701 nt, Artificial Sequence
  derived and/or modified sequence opt1 from hemagglutinin__InfluenzaA__ADD23102
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagaaguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 65215 - RNA, 1701 nt, Artificial Sequence; identical to SEQ ID NO: 64779
  derived and/or modified sequence opt1 from hemagglutinin__InfluenzaA__ADD23112

SEQ ID NO: 65216 - RNA, 1701 nt, Artificial Sequence; identical to SEQ ID NO: 64779
  derived and/or modified sequence opt1 from hemagglutinin__InfluenzaA__ADD23122

SEQ ID NO: 65217 - RNA, 1701 nt, Artificial Sequence; identical to SEQ ID NO: 63677
  derived and/or modified sequence opt1 from hemagglutinin__InfluenzaA__ADD23132

SEQ ID NO: 65218 - RNA, 1701 nt, Artificial Sequence; identical to SEQ ID NO: 64841
  derived and/or modified sequence opt1 from hemagglutinin__InfluenzaA__ADD23142

SEQ ID NO: 65219 - RNA, 1701 nt, Artificial Sequence
  derived and/or modified sequence opt1 from hemagglutinin__InfluenzaA__ADD23162
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagggccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65220 - RNA, 1701 nt, Artificial Sequence; identical to SEQ ID NO: 64841
  derived and/or modified sequence opt1 from hemagglutinin__InfluenzaA__ADD23172

SEQ ID NO: 65221 - RNA, 1701 nt, Artificial Sequence; identical to SEQ ID NO: 64841
  derived and/or modified sequence opt1 from hemagglutinin__InfluenzaA__ADD23182

SEQ ID NO: 65222 - RNA, 1701 nt, Artificial Sequence; identical to SEQ ID NO: 64841
  derived and/or modified sequence opt1 from hemagglutinin__InfluenzaA__ADD23192

SEQ ID NO: 65223 - RNA, 1701 nt, Artificial Sequence; identical to SEQ ID NO: 64841
  derived and/or modified sequence opt1 from hemagglutinin__InfluenzaA__ADD23202

SEQ ID NO: 65224 - RNA, 1701 nt, Artificial Sequence; identical to SEQ ID NO: 64841
  derived and/or modified sequence opt1 from hemagglutinin__InfluenzaA__ADD23220

SEQ ID NO: 65225 - RNA, 1701 nt, Artificial Sequence; identical to SEQ ID NO: 64837
  derived and/or modified sequence opt1 from hemagglutinin__InfluenzaA__ADD23230

SEQ ID NO: 65226 - RNA, 1701 nt, Artificial Sequence; identical to SEQ ID NO: 64841
  derived and/or modified sequence opt1 from hemagglutinin__InfluenzaA__ADD23240

SEQ ID NO: 65227 - RNA, 1701 nt, Artificial Sequence
  derived and/or modified sequence opt1 from hemagglutinin__InfluenzaA__ADD23260
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65228 - RNA, 1701 nt, Artificial Sequence; identical to SEQ ID NO: 64030
  derived and/or modified sequence opt1 from hemagglutinin__InfluenzaA__ADD23280

SEQ ID NO: 65229 - RNA, 1701 nt, Artificial Sequence
  derived and/or modified sequence opt1 from hemagglutinin__InfluenzaA__ADD23290
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65230 - RNA, 1701 nt, Artificial Sequence; identical to SEQ ID NO: 64841
  derived and/or modified sequence opt1 from hemagglutinin__InfluenzaA__ADD23300

SEQ ID NO: 65231 - RNA, 1701 nt, Artificial Sequence; identical to SEQ ID NO: 65229
  derived and/or modified sequence opt1 from hemagglutinin__InfluenzaA__ADD23310

SEQ ID NO: 65232 - RNA, 1701 nt, Artificial Sequence; identical to SEQ ID NO: 64841
  derived and/or modified sequence opt1 from hemagglutinin__InfluenzaA__ADD23320

SEQ ID NO: 65233 - RNA, 1701 nt, Artificial Sequence
  derived and/or modified sequence opt1 from hemagglutinin__InfluenzaA__ADD23330
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65234 - RNA, 1701 nt, Artificial Sequence
  derived and/or modified sequence opt1 from hemagglutinin__InfluenzaA__ADD23355
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagauguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65235 - RNA, 1701 nt, Artificial Sequence; identical to SEQ ID NO: 65229
  derived and/or modified sequence opt1 from hemagglutinin__InfluenzaA__ADD23375

SEQ ID NO: 65236 - RNA, 1701 nt, Artificial Sequence; identical to SEQ ID NO: 64841
  derived and/or modified sequence opt1 from hemagglutinin__InfluenzaA__ADD23385

SEQ ID NO: 65237 - RNA, 1701 nt, Artificial Sequence
  derived and/or modified sequence opt1 from hemagglutinin__InfluenzaA__ADD23405
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccguggggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65238 - RNA, 1701 nt, Artificial Sequence
  derived and/or modified sequence opt1 from hemagglutinin__InfluenzaA__ADD23415
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65239 - RNA, 1701 nt, Artificial Sequence; identical to SEQ ID NO: 64841
  derived and/or modified sequence opt1 from hemagglutinin__InfluenzaA__ADD23435

SEQ ID NO: 65240 - RNA, 1701 nt, Artificial Sequence
  derived and/or modified sequence opt1 from hemagglutinin__InfluenzaA__ADD23465
augaaggccauccuggccgugcuccuguacaccuucgcgaccgccaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 65241 - RNA, 1701 nt, Artificial Sequence; identical to SEQ ID NO: 64841
  derived and/or modified sequence opt1 from hemagglutinin__InfluenzaA__ADD23475

SEQ ID NO: 65242 - RNA, 1701 nt, Artificial Sequence; identical to SEQ ID NO: 64841
  derived and/or modified sequence opt1 from hemagglutinin__InfluenzaA__ADD23485

SEQ ID NO: 65243 - RNA, 1701 nt, Artificial Sequence
  derived and/or modified sequence opt1 from hemagglutinin__InfluenzaA__ADD23495
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgcgguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65244 - RNA, 1701 nt, Artificial Sequence
  derived and/or modified sequence opt1 from hemagglutinin__InfluenzaA__ADD23505
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgucaagcucgagagcacccgcaucuaccagauccuggccaucuacuccaccguggccagcagccuggugcucgucgugucccugggggccaucagcuucuggaugugcuccaacggcagccugcagugccggaucugcaucuga

SEQ ID NO: 65245 - RNA, 1701 nt, Artificial Sequence; identical to SEQ ID NO: 64841
  derived and/or modified sequence opt1 from hemagglutinin__InfluenzaA__ADD23515

SEQ ID NO: 65246 - RNA, 1701 nt, Artificial Sequence; identical to SEQ ID NO: 64841
  derived and/or modified sequence opt1 from hemagglutinin__InfluenzaA__ADD23994

SEQ ID NO: 65247 - RNA, 1701 nt, Artificial Sequence
  derived and/or modified sequence opt1 from hemagglutinin__InfluenzaA__ADD24004
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65248 - RNA, 1701 nt, Artificial Sequence; identical to SEQ ID NO: 64779
  derived and/or modified sequence opt1 from hemagglutinin__InfluenzaA__ADD24014

SEQ ID NO: 65249 - RNA, 1701 nt, Artificial Sequence
  derived and/or modified sequence opt1 from hemagglutinin__InfluenzaA__ADD52537
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacggcaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 65250 - RNA, 1701 nt, Artificial Sequence; identical to SEQ ID NO: 64841
  derived and/or modified sequence opt1 from hemagglutinin__InfluenzaA__ADD64203

SEQ ID NO: 65251 - RNA, 1701 nt, Artificial Sequence
  derived and/or modified sequence opt1 from hemagglutinin__InfluenzaA__ADD64204
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugaucgagcccggggagaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgcccgggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcucgaguccacccggaucuaccagauccuggcgaucuacagcaccguggccuccagccugguccucguggugagccugggggccaucuccuucuggaugugcagcaacggcucccugcagugccgcaucugcaucuga

SEQ ID NO: 65252 - RNA, 1701 nt, Artificial Sequence; identical to SEQ ID NO: 63677
  derived and/or modified sequence opt1 from hemagglutinin__InfluenzaA__ADD64205

SEQ ID NO: 65253 - RNA, 1701 nt, Artificial Sequence; identical to SEQ ID NO: 63677
  derived and/or modified sequence opt1 from hemagglutinin__InfluenzaA__ADD64206

SEQ ID NO: 65254 - RNA, 1701 nt, Artificial Sequence; identical to SEQ ID NO: 64475
  derived and/or modified sequence opt1 from hemagglutinin__InfluenzaA__ADD64207

SEQ ID NO: 65255 - RNA, 1701 nt, Artificial Sequence
  derived and/or modified sequence opt1 from hemagglutinin__InfluenzaA__ADD64208
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgaccccaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 65256 - RNA, 1701 nt, Artificial Sequence; identical to SEQ ID NO: 64475
  derived and/or modified sequence opt1 from hemagglutinin__InfluenzaA__ADD64209

SEQ ID NO: 65257 - RNA, 1701 nt, Artificial Sequence; identical to SEQ ID NO: 63677
  derived and/or modified sequence opt1 from hemagglutinin__InfluenzaA__ADD64210

SEQ ID NO: 65258 - RNA, 1701 nt, Artificial Sequence; identical to SEQ ID NO: 64475
  derived and/or modified sequence opt1 from hemagglutinin__InfluenzaA__ADD64211

SEQ ID NO: 65259 - RNA, 1701 nt, Artificial Sequence; identical to SEQ ID NO: 63677
  derived and/or modified sequence opt1 from hemagglutinin__InfluenzaA__ADD64212

SEQ ID NO: 65260 - RNA, 1701 nt, Artificial Sequence; identical to SEQ ID NO: 64475
  derived and/or modified sequence opt1 from hemagglutinin__InfluenzaA__ADD64213

SEQ ID NO: 65261 - RNA, 1701 nt, Artificial Sequence
  derived and/or modified sequence opt1 from hemagglutinin__InfluenzaA__ADD64214
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucaacaagagcuacaucaacgacaagggcaaggaggugcugguccugugggggauccaccaccccagcaccuccgcggaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacggcaucaccaacaaggugaacuccgucaucgagaagaugaacacccaguucacggcggugggcaaggaguucaaccaccuggagaagcgcaucgagaaccugaacaagaaggucgacgacggguuccuggacaucuggaccuacaacgccgagcuccuggugcugcucgagaacgagcggacccuggacuaccacgacagcaacgugaagaaccuguacgagaagguccgcucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacuccaccgucgcgagcagccuggugcugguggucucccucggcgccaucagcuucuggaugugcuccaacggcagccugcagugccggaucugcaucuga

SEQ ID NO: 65262 - RNA, 1701 nt, Artificial Sequence; identical to SEQ ID NO: 63677
  derived and/or modified sequence opt1 from hemagglutinin__InfluenzaA__ADD64215

SEQ ID NO: 65263 - RNA, 1701 nt, Artificial Sequence; identical to SEQ ID NO: 64475
  derived and/or modified sequence opt1 from hemagglutinin__InfluenzaA__ADD64216

SEQ ID NO: 65264 - RNA, 1701 nt, Artificial Sequence; identical to SEQ ID NO: 64475
  derived and/or modified sequence opt1 from hemagglutinin__InfluenzaA__ADD64217

SEQ ID NO: 65265 - RNA, 1701 nt, Artificial Sequence
  derived and/or modified sequence opt1 from hemagglutinin__InfluenzaA__ADD74350
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgcgagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcuggugaagaaggggaacuccuacccgaagcucagcaagagcuacaucaacgacaagggcaaggaggugcugguccugugggggauccaccaccccuccaccagcgccgaccagcagucccucuaccagaacgccgacgccuacguguucgugggcagcucccgguacagcaagaaguucaagcccgagaucgccauccgccccaagguccgggaccaggagggccgcaugaacuacuacuggacgcugguggagccgggggacaagaucaccuucgaggcgaccggcaaccugguggucccccgguacgccuucgccauggagcgcaacgccggguccggcaucaucaucagcgacacccccgugcacgacugcaacacgaccugccagacccccaagggcgccaucaacaccucccucccguuccagaacauccaccccaucacgaucgggaagugccccaaguacgucaagagcaccaagcugcggcuggcgaccggccuccgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcuggagagcacccgcaucuaccagauccucgcgaucuacagcaccgucgccuccagccuggugcugguggucucccucggggccaucagcuucuggaugugcuccaacggcagccugcagugccggaucugcaucuga

SEQ ID NO: 65266 - RNA, 1701 nt, Artificial Sequence
  derived and/or modified sequence opt1 from hemagglutinin__InfluenzaA__ADD74360
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagcggaaggaggugcugguccucuggggcauccaccaccccagcaccuccgccgaccagcagagccuguaccagaacgccgacgccuacguguucguggggacgucccgcuacagcaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacgggagccugcagugccgcaucugcaucuga

SEQ ID NO: 65267 - RNA, 1701 nt, Artificial Sequence; identical to SEQ ID NO: 63677
  derived and/or modified sequence opt1 from hemagglutinin__InfluenzaA__ADD74370

SEQ ID NO: 65268 - RNA, 1701 nt, Artificial Sequence; identical to SEQ ID NO: 63677
  derived and/or modified sequence opt1 from hemagglutinin__InfluenzaA__ADD74398

SEQ ID NO: 65269 - RNA, 1701 nt, Artificial Sequence
  derived and/or modified sequence opt1 from hemagglutinin__InfluenzaA__ADD74428
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65270 - RNA, 1701 nt, Artificial Sequence
  derived and/or modified sequence opt1 from hemagglutinin__InfluenzaA__ADD74438
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagcccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65271 - RNA, 1701 nt, Artificial Sequence; identical to SEQ ID NO: 63677
  derived and/or modified sequence opt1 from hemagglutinin__InfluenzaA__ADD74448

SEQ ID NO: 65272 - RNA, 1701 nt, Artificial Sequence; identical to SEQ ID NO: 63677
  derived and/or modified sequence opt1 from hemagglutinin__InfluenzaA__ADD74458

SEQ ID NO: 65273 - RNA, 1701 nt, Artificial Sequence
  derived and/or modified sequence opt1 from hemagglutinin__InfluenzaA__ADD74468
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucaccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65274 - RNA, 1701 nt, Artificial Sequence
  derived and/or modified sequence opt1 from hemagglutinin__InfluenzaA__ADD74488
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65275 - RNA, 1701 nt, Artificial Sequence; identical to SEQ ID NO: 63677
  derived and/or modified sequence opt1 from hemagglutinin__InfluenzaA__ADD74498

SEQ ID NO: 65276 - RNA, 1701 nt, Artificial Sequence
  derived and/or modified sequence opt1 from hemagglutinin__InfluenzaA__ADD74508
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccgaggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65277 - RNA, 1701 nt, Artificial Sequence
  derived and/or modified sequence opt1 from hemagglutinin__InfluenzaA__ADD74518
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacacgggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 65278 - RNA, 1701 nt, Artificial Sequence
  derived and/or modified sequence opt1 from hemagglutinin__InfluenzaA__ADD74528
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguuccagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65279 - RNA, 1701 nt, Artificial Sequence
  derived and/or modified sequence opt1 from hemagglutinin__InfluenzaA__ADD74538
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccguguacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65280 - RNA, 1701 nt, Artificial Sequence; identical to SEQ ID NO: 65274
  derived and/or modified sequence opt1 from hemagglutinin__InfluenzaA__ADD74548

SEQ ID NO: 65281 - RNA, 1701 nt, Artificial Sequence; identical to SEQ ID NO: 64841
  derived and/or modified sequence opt1 from hemagglutinin__InfluenzaA__ADD74558

SEQ ID NO: 65282 - RNA, 1701 nt, Artificial Sequence; identical to SEQ ID NO: 65229
  derived and/or modified sequence opt1 from hemagglutinin__InfluenzaA__ADD74568

SEQ ID NO: 65283 - RNA, 1701 nt, Artificial Sequence
  derived and/or modified sequence opt1 from hemagglutinin__InfluenzaA__ADD74578
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccagcuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcacggaccagcagucccuguaccagaacgcggacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgccuucgcgauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgccagcucccuggugcucguggucagccugggggcgaucuccuucuggaugugcagcaacggcucccugcagugccggaucugcaucuga

SEQ ID NO: 65284 - RNA, 1701 nt, Artificial Sequence
  derived and/or modified sequence opt1 from hemagglutinin__InfluenzaA__ADD74588
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgacggccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggccaccgggaaccucguggucccccgguacgcguucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgccaccgggcugcgcaacgugccguccauccagagccggggccuguucggggcgaucgccggcuucaucgagggcggguggacgggcaugguggacgggugguacggcuaccaccaccagaacgagcagggguccggcuacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccaaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 65285 - RNA, 1701 nt, Artificial Sequence; identical to SEQ ID NO: 65229
  derived and/or modified sequence opt1 from hemagglutinin__InfluenzaA__ADD74598

SEQ ID NO: 65286 - RNA, 1701 nt, Artificial Sequence; identical to SEQ ID NO: 65229
  derived and/or modified sequence opt1 from hemagglutinin__InfluenzaA__ADD74608

SEQ ID NO: 65287 - RNA, 1701 nt, Artificial Sequence; identical to SEQ ID NO: 64841
  derived and/or modified sequence opt1 from hemagglutinin__InfluenzaA__ADD74618

SEQ ID NO: 65288 - RNA, 1701 nt, Artificial Sequence
  derived and/or modified sequence opt1 from hemagglutinin__InfluenzaA__ADD74628
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggcgaucuacuccaccguggccagcagccuggugcucgucgugucccugggggccaucagcuucuggaugugcuccaacggcagccugcagugccgcaucugcaucuga

SEQ ID NO: 65289 - RNA, 1701 nt, Artificial Sequence; identical to SEQ ID NO: 64778
  derived and/or modified sequence opt1 from hemagglutinin__InfluenzaA__ADD74648

SEQ ID NO: 65290 - RNA, 1701 nt, Artificial Sequence
  derived and/or modified sequence opt1 from hemagglutinin__InfluenzaA__ADD74658
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65291 - RNA, 1701 nt, Artificial Sequence; identical to SEQ ID NO: 65229
  derived and/or modified sequence opt1 from hemagglutinin__InfluenzaA__ADD74668

SEQ ID NO: 65292 - RNA, 1701 nt, Artificial Sequence; identical to SEQ ID NO: 65269
  derived and/or modified sequence opt1 from hemagglutinin__InfluenzaA__ADD74678

SEQ ID NO: 65293 - RNA, 1701 nt, Artificial Sequence; identical to SEQ ID NO: 65229
  derived and/or modified sequence opt1 from hemagglutinin__InfluenzaA__ADD74688

SEQ ID NO: 65294 - RNA, 1701 nt, Artificial Sequence
  derived and/or modified sequence opt1 from hemagglutinin__InfluenzaA__ADD74698
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65295 - RNA, 1701 nt, Artificial Sequence; identical to SEQ ID NO: 65229
  derived and/or modified sequence opt1 from hemagglutinin__InfluenzaA__ADD74708

SEQ ID NO: 65296 - RNA, 1701 nt, Artificial Sequence
  derived and/or modified sequence opt1 from hemagglutinin__InfluenzaA__ADD74728
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagcguggugcuggucgugucccucggggccaucagcuucuggaugugcuccaacggcagccugcagugccggaucugcaucuga

SEQ ID NO: 65297 - RNA, 1701 nt, Artificial Sequence
  derived and/or modified sequence opt1 from hemagglutinin__InfluenzaA__ADD74738
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgcggagcugguccuacaucguggagaccagcuccagcgacaacggcacgugcuaccccggcgacuucaucgacuacgaggagcuccgcgagcagcuguccagcguguccagcuucgagcgguucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcggcuacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65298 - RNA, 1701 nt, Artificial Sequence; identical to SEQ ID NO: 64841
  derived and/or modified sequence opt1 from hemagglutinin__InfluenzaA__ADD74748

SEQ ID NO: 65299 - RNA, 1701 nt, Artificial Sequence; identical to SEQ ID NO: 64841
  derived and/or modified sequence opt1 from hemagglutinin__InfluenzaA__ADD74758

SEQ ID NO: 65300 - RNA, 1701 nt, Artificial Sequence
  derived and/or modified sequence opt1 from hemagglutinin__InfluenzaA__ADD74768
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcauguccuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65301 - RNA, 1701 nt, Artificial Sequence; identical to SEQ ID NO: 64841
  derived and/or modified sequence opt1 from hemagglutinin__InfluenzaA__ADD74778

SEQ ID NO: 65302 - RNA, 1701 nt, Artificial Sequence; identical to SEQ ID NO: 65229
  derived and/or modified sequence opt1 from hemagglutinin__InfluenzaA__ADD74788

SEQ ID NO: 65303 - RNA, 1701 nt, Artificial Sequence; identical to SEQ ID NO: 65229
  derived and/or modified sequence opt1 from hemagglutinin__InfluenzaA__ADD74798

SEQ ID NO: 65304 - RNA, 1701 nt, Artificial Sequence
  derived and/or modified sequence opt1 from hemagglutinin__InfluenzaA__ADD74808
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccgccgccagcucccuggugcugguggucagccucggggccaucuccuucuggaugugcagcaacggcucccugcagugccggaucugcaucuga

SEQ ID NO: 65305 - RNA, 1701 nt, Artificial Sequence
  derived and/or modified sequence opt1 from hemagglutinin__InfluenzaA__ADD74818
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65306 - RNA, 1701 nt, Artificial Sequence
  derived and/or modified sequence opt1 from hemagglutinin__InfluenzaA__ADD74838
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65307 - RNA, 1701 nt, Artificial Sequence
  derived and/or modified sequence opt1 from hemagglutinin__InfluenzaA__ADD74848
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucaucgugucccugggggccaucagcuucuggaugugcuccaacggcagccugcagugccggaucugcaucuga

SEQ ID NO: 65308 - RNA, 1701 nt, Artificial Sequence
  derived and/or modified sequence opt1 from hemagglutinin__InfluenzaA__ADD74858
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcaccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65309 - RNA, 1701 nt, Artificial Sequence; identical to SEQ ID NO: 65229
  derived and/or modified sequence opt1 from hemagglutinin__InfluenzaA__ADD74868

SEQ ID NO: 65310 - RNA, 1701 nt, Artificial Sequence; identical to SEQ ID NO: 65229
  derived and/or modified sequence opt1 from hemagglutinin__InfluenzaA__ADD74878

SEQ ID NO: 65311 - RNA, 1701 nt, Artificial Sequence
  derived and/or modified sequence opt1 from hemagglutinin__InfluenzaA__ADD74888
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccaacagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65312 - RNA, 1701 nt, Artificial Sequence
  derived and/or modified sequence opt1 from hemagglutinin__InfluenzaA__ADD74898
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65313 - RNA, 1701 nt, Artificial Sequence
  derived and/or modified sequence opt1 from hemagglutinin__InfluenzaA__ADD74908
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65314 - RNA, 1701 nt, Artificial Sequence; identical to SEQ ID NO: 65307
  derived and/or modified sequence opt1 from hemagglutinin__InfluenzaA__ADD74918

SEQ ID NO: 65315 - RNA, 1701 nt, Artificial Sequence; identical to SEQ ID NO: 65229
  derived and/or modified sequence opt1 from hemagglutinin__InfluenzaA__ADD74928

SEQ ID NO: 65316 - RNA, 1701 nt, Artificial Sequence; identical to SEQ ID NO: 65307
  derived and/or modified sequence opt1 from hemagglutinin__InfluenzaA__ADD74938

SEQ ID NO: 65317 - RNA, 1701 nt, Artificial Sequence
  derived and/or modified sequence opt1 from hemagglutinin__InfluenzaA__ADD74958
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65318 - RNA, 1701 nt, Artificial Sequence; identical to SEQ ID NO: 64841
  derived and/or modified sequence opt1 from hemagglutinin__InfluenzaA__ADD74968

SEQ ID NO: 65319 - RNA, 1701 nt, Artificial Sequence
  derived and/or modified sequence opt1 from hemagglutinin__InfluenzaA__ADD74998
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcgcggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65320 - RNA, 1701 nt, Artificial Sequence; identical to SEQ ID NO: 64841
  derived and/or modified sequence opt1 from hemagglutinin__InfluenzaA__ADD75008

SEQ ID NO: 65321 - RNA, 1701 nt, Artificial Sequence; identical to SEQ ID NO: 64841
  derived and/or modified sequence opt1 from hemagglutinin__InfluenzaA__ADD75018

SEQ ID NO: 65322 - RNA, 1701 nt, Artificial Sequence; identical to SEQ ID NO: 64841
  derived and/or modified sequence opt1 from hemagglutinin__InfluenzaA__ADD75028

SEQ ID NO: 65323 - RNA, 1701 nt, Artificial Sequence; identical to SEQ ID NO: 64778
  derived and/or modified sequence opt1 from hemagglutinin__InfluenzaA__ADD75058

SEQ ID NO: 65324 - RNA, 1701 nt, Artificial Sequence; identical to SEQ ID NO: 65097
  derived and/or modified sequence opt1 from hemagglutinin__InfluenzaA__ADD75088

SEQ ID NO: 65325 - RNA, 1701 nt, Artificial Sequence; identical to SEQ ID NO: 63677
  derived and/or modified sequence opt1 from hemagglutinin__InfluenzaA__ADD75098

SEQ ID NO: 65326 - RNA, 1701 nt, Artificial Sequence
  derived and/or modified sequence opt1 from hemagglutinin__InfluenzaA__ADD75108
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65327 - RNA, 1701 nt, Artificial Sequence; identical to SEQ ID NO: 63677
  derived and/or modified sequence opt1 from hemagglutinin__InfluenzaA__ADD75118

SEQ ID NO: 65328 - RNA, 1701 nt, Artificial Sequence; identical to SEQ ID NO: 64124
  derived and/or modified sequence opt1 from hemagglutinin__InfluenzaA__ADD75128

SEQ ID NO: 65329 - RNA, 1701 nt, Artificial Sequence; identical to SEQ ID NO: 63677
  derived and/or modified sequence opt1 from hemagglutinin__InfluenzaA__ADD75138

SEQ ID NO: 65330 - RNA, 1701 nt, Artificial Sequence; identical to SEQ ID NO: 64841
  derived and/or modified sequence opt1 from hemagglutinin__InfluenzaA__ADD75148

SEQ ID NO: 65331 - RNA, 1701 nt, Artificial Sequence; identical to SEQ ID NO: 63677
  derived and/or modified sequence opt1 from hemagglutinin__InfluenzaA__ADD75158

SEQ ID NO: 65332 - RNA, 1701 nt, Artificial Sequence
  derived and/or modified sequence opt1 from hemagglutinin__InfluenzaA__ADD84494
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaucagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcaccagccgguacuccaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacaccccggugcacggcugcaacacgaccugccagacccccaagggggccaucaacaccagccugcccuuccagaacauccaccccaucacgaucggcaagugcccgaaguacgugaaguccaccaagcugcggcucgcgaccgggcugcgcaacguccccagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65333 - RNA, 1701 nt, Artificial Sequence
  derived and/or modified sequence opt1 from hemagglutinin__InfluenzaA__ADD84495
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaucagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcaccagccgguacuccaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacaccccggugcacgacugcaacacgaccugccagacccccaagggcgccaucaacaccagccugcccuuccagaacauccaccccaucacgaucgggaagugcccgaaguacgugaaguccaccaagcugcggcucgcgaccggccugcgcaacguccccagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65334 - RNA, 1701 nt, Artificial Sequence
  derived and/or modified sequence opt1 from hemagglutinin__InfluenzaA__ADD84496
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaucagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagccggagaucgccauccgccccaagguccgggaccaggagggccgcaugaacuacuacuggacccugguggagcccggggacaagaucacguucgaggcgaccggcaaccucguggucccccgguacgccuucgccauggagcgcaacgccggguccggcaucaucaucagcgacaccccggugcacgacugcaacaccacgugccagacccccaagggcgccaucaacaccucccugcccuuccagaacauccaccccaucaccaucgggaagugcccgaaguacgucaagagcacgaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65335 - RNA, 1701 nt, Artificial Sequence; identical to SEQ ID NO: 65333
  derived and/or modified sequence opt1 from hemagglutinin__InfluenzaA__ADD84497

SEQ ID NO: 65336 - RNA, 1701 nt, Artificial Sequence
  derived and/or modified sequence opt1 from hemagglutinin__InfluenzaA__ADD84498
augaaggccauccuggugguccuccuguacaccuucgccaccgcgaacgccgacacgcugugcaucggcuaccacgccaacaacagcaccgacaccguggugaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaucagcuccuggcccaaccacgacccgaacaagggggugaccgccgccugcccccacgccggcgccaagagcuucuacaagaaccugaucuggcucgugaagaaggggaacuccuaccccaagcugagcaaguccuacaucaacgacaagggcaaggagguccuggugcucugggggauccaccaccccagcaccagcgccgaccagcagucccuguaccagaacgccgacgccuacguguucgucggcagcucccgguacagcaagaaguucaagccggagaucgccauccgccccaaggugcgggaccaggagggccgcaugaacuacuacuggacccugguggagcccggggacaagaucacguucgaggcgaccggcaaccucgucgugccccgguacgccuucgccauggagcgcaacgccggguccggcaucaucaucagcgacaccccggugcacgacugcaacaccacgugccagacccccaagggcgccaucaacaccucccugcccuuccagaacauccaccccaucaccaucgggaagugcccgaaguacgucaagagcacgaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggucaacuccgugaucgagaagaugaacacccaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65337 - RNA, 1701 nt, Artificial Sequence; identical to SEQ ID NO: 65333
  derived and/or modified sequence opt1 from hemagglutinin__InfluenzaA__ADD84499

SEQ ID NO: 65338 - RNA, 1701 nt, Artificial Sequence
  derived and/or modified sequence opt1 from hemagglutinin__InfluenzaA__ADD92535
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaaccgggugaacuccgucaucgagaagaugaacacccaguucacggccgugggcaaggaguucaaccaccuggagaagcgcaucgagaaccugaacaagaaggucgacggcggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 65339 - RNA, 1701 nt, Artificial Sequence; identical to SEQ ID NO: 65265
  derived and/or modified sequence opt1 from hemagglutinin__InfluenzaA__ADD96766

SEQ ID NO: 65340 - RNA, 1701 nt, Artificial Sequence; identical to SEQ ID NO: 63857
  derived and/or modified sequence opt1 from hemagglutinin__InfluenzaA__ADD96776

SEQ ID NO: 65341 - RNA, 1701 nt, Artificial Sequence; identical to SEQ ID NO: 63857
  derived and/or modified sequence opt1 from hemagglutinin__InfluenzaA__ADD96786

SEQ ID NO: 65342 - RNA, 1701 nt, Artificial Sequence; identical to SEQ ID NO: 65162
  derived and/or modified sequence opt1 from hemagglutinin__InfluenzaA__ADD96796

SEQ ID NO: 65343 - RNA, 1701 nt, Artificial Sequence
  derived and/or modified sequence opt1 from hemagglutinin__InfluenzaA__ADD96806
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 65344 - RNA, 1701 nt, Artificial Sequence; identical to SEQ ID NO: 64841
  derived and/or modified sequence opt1 from hemagglutinin__InfluenzaA__ADD96816

SEQ ID NO: 65345 - RNA, 1701 nt, Artificial Sequence
  derived and/or modified sequence opt1 from hemagglutinin__InfluenzaA__ADD96826
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaaggucauggaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucgccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgcgaggagaucgacggcgugaagcucgagagcacccggaucuaccagauccuggccaucuacuccaccgucgccagcagccuggugcucguggucucccugggggccaucagcuucuggaugugcuccaacggcagccugcagugccgcaucugcaucuga

SEQ ID NO: 65346 - RNA, 1701 nt, Artificial Sequence; identical to SEQ ID NO: 63677
  derived and/or modified sequence opt1 from hemagglutinin__InfluenzaA__ADD96836

SEQ ID NO: 65347 - RNA, 1701 nt, Artificial Sequence; identical to SEQ ID NO: 63677
  derived and/or modified sequence opt1 from hemagglutinin__InfluenzaA__ADD96846

SEQ ID NO: 65348 - RNA, 1701 nt, Artificial Sequence; identical to SEQ ID NO: 65229
  derived and/or modified sequence opt1 from hemagglutinin__InfluenzaA__ADD96856

SEQ ID NO: 65349 - RNA, 1701 nt, Artificial Sequence; identical to SEQ ID NO: 64030
  derived and/or modified sequence opt1 from hemagglutinin__InfluenzaA__ADD96886

SEQ ID NO: 65350 - RNA, 1701 nt, Artificial Sequence; identical to SEQ ID NO: 65304
  derived and/or modified sequence opt1 from hemagglutinin__InfluenzaA__ADD96896

SEQ ID NO: 65351 - RNA, 1701 nt, Artificial Sequence; identical to SEQ ID NO: 64841
  derived and/or modified sequence opt1 from hemagglutinin__InfluenzaA__ADD96906

SEQ ID NO: 65352 - RNA, 1701 nt, Artificial Sequence; identical to SEQ ID NO: 64841
  derived and/or modified sequence opt1 from hemagglutinin__InfluenzaA__ADD96916

SEQ ID NO: 65353 - RNA, 1701 nt, Artificial Sequence; identical to SEQ ID NO: 64841
  derived and/or modified sequence opt1 from hemagglutinin__InfluenzaA__ADD96926

SEQ ID NO: 65354 - RNA, 1701 nt, Artificial Sequence
  derived and/or modified sequence opt1 from hemagglutinin__InfluenzaA__ADD96936
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcugaucaagaaggggaacagcuaccccaagcucuccaagagcuacaucaacgacaagggcaaggaggugcuggugcugugggggauccaccaccccagcaccuccgccgaccagcagagccucuaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgcgaucuacuccaccguggccagcagccugguccugguggugucccucggggccaucagcuucuggaugugcuccaacggcagccugcagugccggaucugcaucuga

SEQ ID NO: 65355 - RNA, 1701 nt, Artificial Sequence
  derived and/or modified sequence opt1 from hemagglutinin__InfluenzaA__ADD96946
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucaagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65356 - RNA, 1701 nt, Artificial Sequence
  derived and/or modified sequence opt1 from hemagglutinin__InfluenzaA__ADD96956
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65357 - RNA, 1701 nt, Artificial Sequence; identical to SEQ ID NO: 63677
  derived and/or modified sequence opt1 from hemagglutinin__InfluenzaA__ADD96976

SEQ ID NO: 65358 - RNA, 1701 nt, Artificial Sequence; identical to SEQ ID NO: 63677
  derived and/or modified sequence opt1 from hemagglutinin__InfluenzaA__ADD96986

SEQ ID NO: 65359 - RNA, 1701 nt, Artificial Sequence
  derived and/or modified sequence opt1 from hemagglutinin__InfluenzaA__ADD97035
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65360 - RNA, 1701 nt, Artificial Sequence
  derived and/or modified sequence opt1 from hemagglutinin__InfluenzaA__ADD97045
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaccgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65361 - RNA, 1701 nt, Artificial Sequence; identical to SEQ ID NO: 65360
  derived and/or modified sequence opt1 from hemagglutinin__InfluenzaA__ADD97055

SEQ ID NO: 65362 - RNA, 1701 nt, Artificial Sequence; identical to SEQ ID NO: 65360
  derived and/or modified sequence opt1 from hemagglutinin__InfluenzaA__ADD97123

SEQ ID NO: 65363 - RNA, 1701 nt, Artificial Sequence
  derived and/or modified sequence opt1 from hemagglutinin__InfluenzaA__ADD97161
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagggcaagagcuaccccaagcuguccaagagcuacaucaacgacaaggggaagaaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65364 - RNA, 1701 nt, Artificial Sequence
  derived and/or modified sequence opt1 from hemagglutinin__InfluenzaA__ADD97171
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccgugagcuucuggaugugcuccaacggcagccugcagugccggaucugcaucuga

SEQ ID NO: 65365 - RNA, 1701 nt, Artificial Sequence; identical to SEQ ID NO: 63677
  derived and/or modified sequence opt1 from hemagglutinin__InfluenzaA__ADD97181

SEQ ID NO: 65366 - RNA, 1701 nt, Artificial Sequence; identical to SEQ ID NO: 63677
  derived and/or modified sequence opt1 from hemagglutinin__InfluenzaA__ADD97201

SEQ ID NO: 65367 - RNA, 1701 nt, Artificial Sequence; identical to SEQ ID NO: 65360
  derived and/or modified sequence opt1 from hemagglutinin__InfluenzaA__ADD97211

SEQ ID NO: 65368 - RNA, 1701 nt, Artificial Sequence; identical to SEQ ID NO: 63677
  derived and/or modified sequence opt1 from hemagglutinin__InfluenzaA__ADD97231

SEQ ID NO: 65369 - RNA, 1701 nt, Artificial Sequence
  derived and/or modified sequence opt1 from hemagglutinin__InfluenzaA__ADD97241
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaccgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacaacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65370 - RNA, 1701 nt, Artificial Sequence; identical to SEQ ID NO: 65360
  derived and/or modified sequence opt1 from hemagglutinin__InfluenzaA__ADD97251

SEQ ID NO: 65371 - RNA, 1701 nt, Artificial Sequence; identical to SEQ ID NO: 63677
  derived and/or modified sequence opt1 from hemagglutinin__InfluenzaA__ADD97261

SEQ ID NO: 65372 - RNA, 1701 nt, Artificial Sequence
  derived and/or modified sequence opt1 from hemagglutinin__InfluenzaA__ADD97271
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgcggccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 65373 - RNA, 1701 nt, Artificial Sequence; identical to SEQ ID NO: 65364
  derived and/or modified sequence opt1 from hemagglutinin__InfluenzaA__ADD97281

SEQ ID NO: 65374 - RNA, 1701 nt, Artificial Sequence; identical to SEQ ID NO: 63677
  derived and/or modified sequence opt1 from hemagglutinin__InfluenzaA__ADD97291

SEQ ID NO: 65375 - RNA, 1701 nt, Artificial Sequence
  derived and/or modified sequence opt1 from hemagglutinin__InfluenzaA__ADD97311
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccaucgccgaccagcagucccuguaccagaacgccgacgccuacguguucgucggcacgagccgguacuccaagaaguucaagcccgagaucgccauccgcccgaaggugcgggaccaggagggccgcaugaaguacuacuggacccugguggagcccggggacaagaucaccuucgaggcgaccggcaaccucgucgugccccgguacgccuucgccauggagcgcaacgccgggagcggcaucaucaucuccgacacgcccgugcacaacugcaacacgaccugccagaccagcaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65376 - RNA, 1701 nt, Artificial Sequence; identical to SEQ ID NO: 65360
  derived and/or modified sequence opt1 from hemagglutinin__InfluenzaA__ADD97321

SEQ ID NO: 65377 - RNA, 1701 nt, Artificial Sequence; identical to SEQ ID NO: 64841
  derived and/or modified sequence opt1 from hemagglutinin__InfluenzaA__ADD97331

SEQ ID NO: 65378 - RNA, 1701 nt, Artificial Sequence
  derived and/or modified sequence opt1 from hemagglutinin__InfluenzaA__ADD97341
augaaggccauccuggugguccuccuguacaccuucgccaccgugaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccacggaccagcagagccuguaccagaacgcggacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgccuucgcgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacaucccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 65379 - RNA, 1701 nt, Artificial Sequence; identical to SEQ ID NO: 64841
  derived and/or modified sequence opt1 from hemagglutinin__InfluenzaA__ADD97351

SEQ ID NO: 65380 - RNA, 1701 nt, Artificial Sequence; identical to SEQ ID NO: 64841
  derived and/or modified sequence opt1 from hemagglutinin__InfluenzaA__ADD97361

SEQ ID NO: 65381 - RNA, 1701 nt, Artificial Sequence
  derived and/or modified sequence opt1 from hemagglutinin__InfluenzaA__ADD97371
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccgggugugcaucuga

SEQ ID NO: 65382 - RNA, 1701 nt, Artificial Sequence; identical to SEQ ID NO: 64841
  derived and/or modified sequence opt1 from hemagglutinin__InfluenzaA__ADD97381

SEQ ID NO: 65383 - RNA, 1701 nt, Artificial Sequence; identical to SEQ ID NO: 63677
  derived and/or modified sequence opt1 from hemagglutinin__InfluenzaA__ADD97391

SEQ ID NO: 65384 - RNA, 1701 nt, Artificial Sequence; identical to SEQ ID NO: 64841
  derived and/or modified sequence opt1 from hemagglutinin__InfluenzaA__ADD97411

SEQ ID NO: 65385 - RNA, 1701 nt, Artificial Sequence; identical to SEQ ID NO: 64841
  derived and/or modified sequence opt1 from hemagglutinin__InfluenzaA__ADD97421

SEQ ID NO: 65386 - RNA, 1701 nt, Artificial Sequence; identical to SEQ ID NO: 63677
  derived and/or modified sequence opt1 from hemagglutinin__InfluenzaA__ADD97431

SEQ ID NO: 65387 - RNA, 1701 nt, Artificial Sequence
  derived and/or modified sequence opt1 from hemagglutinin__InfluenzaA__ADD97441
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65388 - RNA, 1701 nt, Artificial Sequence; identical to SEQ ID NO: 65381
  derived and/or modified sequence opt1 from hemagglutinin__InfluenzaA__ADD97451

SEQ ID NO: 65389 - RNA, 1701 nt, Artificial Sequence; identical to SEQ ID NO: 65381
  derived and/or modified sequence opt1 from hemagglutinin__InfluenzaA__ADD97461

SEQ ID NO: 65390 - RNA, 1701 nt, Artificial Sequence; identical to SEQ ID NO: 65229
  derived and/or modified sequence opt1 from hemagglutinin__InfluenzaA__ADD97471

SEQ ID NO: 65391 - RNA, 1701 nt, Artificial Sequence; identical to SEQ ID NO: 65229
  derived and/or modified sequence opt1 from hemagglutinin__InfluenzaA__ADD97481

SEQ ID NO: 65392 - RNA, 1701 nt, Artificial Sequence
  derived and/or modified sequence opt1 from hemagglutinin__InfluenzaA__ADD97491
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgaggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65393 - RNA, 1701 nt, Artificial Sequence; identical to SEQ ID NO: 65392
  derived and/or modified sequence opt1 from hemagglutinin__InfluenzaA__ADD97501

SEQ ID NO: 65394 - RNA, 1701 nt, Artificial Sequence; identical to SEQ ID NO: 64030
  derived and/or modified sequence opt1 from hemagglutinin__InfluenzaA__ADD97511

SEQ ID NO: 65395 - RNA, 1701 nt, Artificial Sequence
  derived and/or modified sequence opt1 from hemagglutinin__InfluenzaA__ADD97531
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccaucgccgaccagcagucccuguaccagaacgccgacgccuacguguucgucggcacgagccgguacuccaagaaguucaagcccgagaucgccauccgcccgaaggugcgggaccaggagggccgcaugaaguacuacuggacccugguggagcccggggacaagaucaccuucgaggcgaccggcaaccucgucgugccccgguacgccuucgccauggagcgcaacgccgggagcggcaucaucaucuccgacacgcccgugcacaacugcaacacgaccugccagaccccgaagggcgccaucaacaccagccugcccuuccagaacauccaccccaucaccaucgggaagugccccaaguacgucaaguccaccaagcugcggcucgcgaccggccugcgcaacgugccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacagcgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 65396 - RNA, 1701 nt, Artificial Sequence
  derived and/or modified sequence opt1 from hemagglutinin__InfluenzaA__ADD97541
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacaccggcgccaaguccuucuacaagaaccugaucuggcucgugaagaaggggaacagcuaccccaagcuguccaagagcuacaucaacgacaagggcaaggaggugcugguccucugggggauccaccaccccagcacguccaccgaccagcagagccuguaccagaacgcggacgcccacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacaucccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcugguccuccuggagaacgagcggacgcuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggccagcagccugguccucguggugucccugggggcgaucagcuucuggaugugcuccaacggcagccugcagugccggaucugcaucuga

SEQ ID NO: 65397 - RNA, 1701 nt, Artificial Sequence; identical to SEQ ID NO: 65229
  derived and/or modified sequence opt1 from hemagglutinin__InfluenzaA__ADD97551

SEQ ID NO: 65398 - RNA, 1701 nt, Artificial Sequence; identical to SEQ ID NO: 64841
  derived and/or modified sequence opt1 from hemagglutinin__InfluenzaA__ADD97561

SEQ ID NO: 65399 - RNA, 1701 nt, Artificial Sequence
  derived and/or modified sequence opt1 from hemagglutinin__InfluenzaA__ADD97571
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagccuguucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 65400 - RNA, 1701 nt, Artificial Sequence; identical to SEQ ID NO: 63677
  derived and/or modified sequence opt1 from hemagglutinin__InfluenzaA__ADD97581

SEQ ID NO: 65401 - RNA, 1701 nt, Artificial Sequence; identical to SEQ ID NO: 63677
  derived and/or modified sequence opt1 from hemagglutinin__InfluenzaA__ADD97591

SEQ ID NO: 65402 - RNA, 1701 nt, Artificial Sequence; identical to SEQ ID NO: 63677
  derived and/or modified sequence opt1 from hemagglutinin__InfluenzaA__ADD97688

SEQ ID NO: 65403 - RNA, 1701 nt, Artificial Sequence; identical to SEQ ID NO: 65229
  derived and/or modified sequence opt1 from hemagglutinin__InfluenzaA__ADD97698

SEQ ID NO: 65404 - RNA, 1701 nt, Artificial Sequence; identical to SEQ ID NO: 65229
  derived and/or modified sequence opt1 from hemagglutinin__InfluenzaA__ADD97888

SEQ ID NO: 65405 - RNA, 1701 nt, Artificial Sequence
  derived and/or modified sequence opt1 from hemagglutinin__InfluenzaA__ADD97898
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 65406 - RNA, 1701 nt, Artificial Sequence; identical to SEQ ID NO: 64030
  derived and/or modified sequence opt1 from hemagglutinin__InfluenzaA__ADD97908

SEQ ID NO: 65407 - RNA, 1701 nt, Artificial Sequence; identical to SEQ ID NO: 64841
  derived and/or modified sequence opt1 from hemagglutinin__InfluenzaA__ADD97918

SEQ ID NO: 65408 - RNA, 1701 nt, Artificial Sequence
  derived and/or modified sequence opt1 from hemagglutinin__InfluenzaA__ADD97928
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacggcaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguuccaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65409 - RNA, 1701 nt, Artificial Sequence
  derived and/or modified sequence opt1 from hemagglutinin__InfluenzaA__ADD97938
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaugaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65410 - RNA, 1701 nt, Artificial Sequence
  derived and/or modified sequence opt1 from hemagglutinin__InfluenzaA__ADD97948
augaaggccauccugcucgugcugcuguacaccuucgccaccgcgaacgccgacacgcucugcaucggcuaccacgccaacaacagcaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagauguuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65411 - RNA, 1701 nt, Artificial Sequence
  derived and/or modified sequence opt1 from hemagglutinin__InfluenzaA__ADD97958
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguuccagcccgagaucgccauccgcccgaagguccgggaccaggagggccgcaugaacuacuacuggacccugcucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65412 - RNA, 1701 nt, Artificial Sequence; identical to SEQ ID NO: 63677
  derived and/or modified sequence opt1 from hemagglutinin__InfluenzaA__ADD97968

SEQ ID NO: 65413 - RNA, 1701 nt, Artificial Sequence; identical to SEQ ID NO: 65405
  derived and/or modified sequence opt1 from hemagglutinin__InfluenzaA__ADD97978

SEQ ID NO: 65414 - RNA, 1701 nt, Artificial Sequence; identical to SEQ ID NO: 65359
  derived and/or modified sequence opt1 from hemagglutinin__InfluenzaA__ADD97988

SEQ ID NO: 65415 - RNA, 1701 nt, Artificial Sequence
  derived and/or modified sequence opt1 from hemagglutinin__InfluenzaA__ADD97998
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgagauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65416 - RNA, 1701 nt, Artificial Sequence; identical to SEQ ID NO: 65229
  derived and/or modified sequence opt1 from hemagglutinin__InfluenzaA__ADD98008

SEQ ID NO: 65417 - RNA, 1701 nt, Artificial Sequence
  derived and/or modified sequence opt1 from hemagglutinin__InfluenzaA__ADD98018
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggagauccuggugcucugggggauccaccaccccagcaccuccgccgaccagcagagccuguaccagaacgccgacgccuacgucuucgugggcacgucccgguacagcaagaaguucaagcccgagaucgccacccgcccgaaggugcgggagcaggagggccgcaugaacuacuacuggacccuggucgagcccggggacaagaucaccuucgaggcgacgggcaaccucguggugccccgguacgccuucgccauggagcgcaacgccggguccggcaucaucaucagcgacacccccguccacgacugcaacacgaccugccagaccccgaagggcgccaucaacaccucccugcccuuccagaacauccacagcaucaccaucgggaagugccccaaguacgugaaguccaccaagcugcggcucgcgacgggccugcgcaacgugcccagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 65418 - RNA, 1701 nt, Artificial Sequence; identical to SEQ ID NO: 65381
  derived and/or modified sequence opt1 from hemagglutinin__InfluenzaA__ADD98028

SEQ ID NO: 65419 - RNA, 1701 nt, Artificial Sequence
  derived and/or modified sequence opt1 from hemagglutinin__InfluenzaA__ADD98038
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcaucuccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccugguggucccccgguacgccuucgagauggagcgcaacgccggguccggcaucaucaucagcgacacccccgugcacgacugcaacacgaccugccagaccccgaagggcgccaucaacaccucccuccccuuccagaacauccaccccaucacgaucgggaagugccccaaguacgucaagagcaccaagcugcggcuggcgaccggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65420 - RNA, 1701 nt, Artificial Sequence; identical to SEQ ID NO: 65405
  derived and/or modified sequence opt1 from hemagglutinin__InfluenzaA__ADD98048

SEQ ID NO: 65421 - RNA, 1701 nt, Artificial Sequence; identical to SEQ ID NO: 63677
  derived and/or modified sequence opt1 from hemagglutinin__InfluenzaA__ADD98058

SEQ ID NO: 65422 - RNA, 1701 nt, Artificial Sequence; identical to SEQ ID NO: 63677
  derived and/or modified sequence opt1 from hemagglutinin__InfluenzaA__ADD98068

SEQ ID NO: 65423 - RNA, 1701 nt, Artificial Sequence; identical to SEQ ID NO: 63919
  derived and/or modified sequence opt1 from hemagglutinin__InfluenzaA__ADD98078

SEQ ID NO: 65424 - RNA, 1701 nt, Artificial Sequence
  derived and/or modified sequence opt1 from hemagglutinin__InfluenzaA__ADD98098
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccagcgaccagcagucccuguaccagaacgccgacgccuacgucuucgugggcacgagccgguacuccaagaaguucaagcccgagaucgccauccgcccgaaggugcgggaccaggagggccgcaugaacuacuacuggacccuggucgagcccggggacaagaucaccuucgaggccaccggcaaccucguggugccccgguacgcguucgccgucgagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65425 - RNA, 1701 nt, Artificial Sequence; identical to SEQ ID NO: 65392
  derived and/or modified sequence opt1 from hemagglutinin__InfluenzaA__ADD98118

SEQ ID NO: 65426 - RNA, 1701 nt, Artificial Sequence; identical to SEQ ID NO: 65392
  derived and/or modified sequence opt1 from hemagglutinin__InfluenzaA__ADD98128

SEQ ID NO: 65427 - RNA, 1701 nt, Artificial Sequence
  derived and/or modified sequence opt1 from hemagglutinin__InfluenzaA__ADD98138
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacaccggguccggcaucaucaucagcgacacccccgugcacgacugcaacaccacgugccagaccccgaacggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 65428 - RNA, 1701 nt, Artificial Sequence
  derived and/or modified sequence opt1 from hemagglutinin__InfluenzaA__ADD98148
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucuucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65429 - RNA, 1701 nt, Artificial Sequence
  derived and/or modified sequence opt1 from hemagglutinin__InfluenzaA__ADD98158
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcgagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucgugaucccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65430 - RNA, 1701 nt, Artificial Sequence
  derived and/or modified sequence opt1 from hemagglutinin__InfluenzaA__ADD98168
augaaggccauccuggugguccuccuguacaccuucgccaccgcgaacgccgacacgcugugcaucggcuaccacgccaacaacagcaccgacaccguggacaccgugcucgagaagaacgucacggugacccacuccaucaacauccuggaggacaagcacaacgggaagcugugcaagcuccgcggcguggcgccccugcaccuggggaagugcaacaucgccggcuggauccucgggaacccggagugcgagagccuguccaccgccagcuccuggagcuacaucgucgagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcuggucaagaaggggaacagcuaccccaagcucuccaagagcuacaucaacgacaagggcaaggaggugcuggugcugugggggauccaccaccccagcaccuccgccgaccagcagagccucuaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccugguggugcccaaguacgccuucgccauggagcggaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccuggacaucuggaccuacaacgccgagcuccugguccugcucgagaacgagcgcacccuggacuaccacgacagcaacgugaagaaccuguacgagaaggugcggucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcuggagagcacccggaucuaccagauccucgcgaucuacuccaccguggccagcagccugguccugguggugucccucggggccaucagcuucuggaugugcuccaacggcagccugcagugccgcaucugcaucuga

SEQ ID NO: 65431 - RNA, 1701 nt, Artificial Sequence; identical to SEQ ID NO: 64849
  derived and/or modified sequence opt1 from hemagglutinin__InfluenzaA__ADD98188

SEQ ID NO: 65432 - RNA, 1701 nt, Artificial Sequence
  derived and/or modified sequence opt1 from hemagglutinin__InfluenzaA__ADD98198
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagaugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65433 - RNA, 1701 nt, Artificial Sequence; identical to SEQ ID NO: 63677
  derived and/or modified sequence opt1 from hemagglutinin__InfluenzaA__ADD98208

SEQ ID NO: 65434 - RNA, 1701 nt, Artificial Sequence; identical to SEQ ID NO: 63857
  derived and/or modified sequence opt1 from hemagglutinin__InfluenzaA__ADE20321

SEQ ID NO: 65435 - RNA, 1701 nt, Artificial Sequence; identical to SEQ ID NO: 63857
  derived and/or modified sequence opt1 from hemagglutinin__InfluenzaA__ADE20331

SEQ ID NO: 65436 - RNA, 1701 nt, Artificial Sequence; identical to SEQ ID NO: 63857
  derived and/or modified sequence opt1 from hemagglutinin__InfluenzaA__ADE20341

SEQ ID NO: 65437 - RNA, 1701 nt, Artificial Sequence; identical to SEQ ID NO: 65265
  derived and/or modified sequence opt1 from hemagglutinin__InfluenzaA__ADE20351

SEQ ID NO: 65438 - RNA, 1701 nt, Artificial Sequence; identical to SEQ ID NO: 63857
  derived and/or modified sequence opt1 from hemagglutinin__InfluenzaA__ADE20375

SEQ ID NO: 65439 - RNA, 1701 nt, Artificial Sequence; identical to SEQ ID NO: 65265
  derived and/or modified sequence opt1 from hemagglutinin__InfluenzaA__ADE20388

SEQ ID NO: 65440 - RNA, 1701 nt, Artificial Sequence; identical to SEQ ID NO: 63857
  derived and/or modified sequence opt1 from hemagglutinin__InfluenzaA__ADE20628

SEQ ID NO: 65441 - RNA, 1701 nt, Artificial Sequence; identical to SEQ ID NO: 65265
  derived and/or modified sequence opt1 from hemagglutinin__InfluenzaA__ADE20638

SEQ ID NO: 65442 - RNA, 1701 nt, Artificial Sequence; identical to SEQ ID NO: 63857
  derived and/or modified sequence opt1 from hemagglutinin__InfluenzaA__ADE20648

SEQ ID NO: 65443 - RNA, 1701 nt, Artificial Sequence; identical to SEQ ID NO: 63857
  derived and/or modified sequence opt1 from hemagglutinin__InfluenzaA__ADE20658

SEQ ID NO: 65444 - RNA, 1701 nt, Artificial Sequence; identical to SEQ ID NO: 65265
  derived and/or modified sequence opt1 from hemagglutinin__InfluenzaA__ADE20668

SEQ ID NO: 65445 - RNA, 1701 nt, Artificial Sequence; identical to SEQ ID NO: 65265
  derived and/or modified sequence opt1 from hemagglutinin__InfluenzaA__ADE20678

SEQ ID NO: 65446 - RNA, 1701 nt, Artificial Sequence; identical to SEQ ID NO: 63857
  derived and/or modified sequence opt1 from hemagglutinin__InfluenzaA__ADE20688

SEQ ID NO: 65447 - RNA, 1701 nt, Artificial Sequence; identical to SEQ ID NO: 63857
  derived and/or modified sequence opt1 from hemagglutinin__InfluenzaA__ADE20708

SEQ ID NO: 65448 - RNA, 1701 nt, Artificial Sequence; identical to SEQ ID NO: 63857
  derived and/or modified sequence opt1 from hemagglutinin__InfluenzaA__ADE20718

SEQ ID NO: 65449 - RNA, 1701 nt, Artificial Sequence
  derived and/or modified sequence opt1 from hemagglutinin__InfluenzaA__ADE20728
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgcgagcagcucagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagcaaguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 65450 - RNA, 1701 nt, Artificial Sequence; identical to SEQ ID NO: 63857
  derived and/or modified sequence opt1 from hemagglutinin__InfluenzaA__ADE20738

SEQ ID NO: 65451 - RNA, 1701 nt, Artificial Sequence; identical to SEQ ID NO: 63857
  derived and/or modified sequence opt1 from hemagglutinin__InfluenzaA__ADE20748

SEQ ID NO: 65452 - RNA, 1701 nt, Artificial Sequence; identical to SEQ ID NO: 65449
  derived and/or modified sequence opt1 from hemagglutinin__InfluenzaA__ADE20758

SEQ ID NO: 65453 - RNA, 1701 nt, Artificial Sequence; identical to SEQ ID NO: 63857
  derived and/or modified sequence opt1 from hemagglutinin__InfluenzaA__ADE20768

SEQ ID NO: 65454 - RNA, 1701 nt, Artificial Sequence
  derived and/or modified sequence opt1 from hemagglutinin__InfluenzaA__ADE20778
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgcgagcagcucagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaagaaggugcugguccugugggggauccaccaccccagcaccuccgccgaccagcagagccucuaccagaacgccgacgccuacguguucgugggcuccagcaaguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 65455 - RNA, 1701 nt, Artificial Sequence; identical to SEQ ID NO: 64841
  derived and/or modified sequence opt1 from hemagglutinin__InfluenzaA__ADE20788

SEQ ID NO: 65456 - RNA, 1701 nt, Artificial Sequence
  derived and/or modified sequence opt1 from hemagglutinin__InfluenzaA__ADE20808
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaaggagaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65457 - RNA, 1701 nt, Artificial Sequence; identical to SEQ ID NO: 64841
  derived and/or modified sequence opt1 from hemagglutinin__InfluenzaA__ADE20818

SEQ ID NO: 65458 - RNA, 1701 nt, Artificial Sequence; identical to SEQ ID NO: 65399
  derived and/or modified sequence opt1 from hemagglutinin__InfluenzaA__ADE20828

SEQ ID NO: 65459 - RNA, 1701 nt, Artificial Sequence
  derived and/or modified sequence opt1 from hemagglutinin__InfluenzaA__ADE20848
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugaucgacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65460 - RNA, 1701 nt, Artificial Sequence; identical to SEQ ID NO: 64841
  derived and/or modified sequence opt1 from hemagglutinin__InfluenzaA__ADE20858

SEQ ID NO: 65461 - RNA, 1701 nt, Artificial Sequence
  derived and/or modified sequence opt1 from hemagglutinin__InfluenzaA__ADE20868
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagagccugaccaccgcguccagcugguccuacaucguggagacgagcuccagcgacaacgggaccugcuaccccggcgacuucaucgacuacgaggagcuccgggagcagcuguccagcguguccagcuucgagcgcuucgagauguuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcacgagcgccgaccagcagucccuguaccagaacgccgacgccuacguguucgugggcaccagccgguacuccaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucgccauggagcgcaacgccggcagcggcaucaucaucuccgacacccccgugcacgacugcaacacgaccugccagaccccgaagggggccaucaacaccagccugcccuuccagaacauccaccccaucaccaucggcaagugccccaaguacgugaaguccaccaagcugcggcucgcgacggggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacccagaacgcgaucgacgagaucaccaacaaggugaacagcgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65462 - RNA, 1701 nt, Artificial Sequence; identical to SEQ ID NO: 65395
  derived and/or modified sequence opt1 from hemagglutinin__InfluenzaA__ADE20878

SEQ ID NO: 65463 - RNA, 1701 nt, Artificial Sequence; identical to SEQ ID NO: 64779
  derived and/or modified sequence opt1 from hemagglutinin__InfluenzaA__ADE20888

SEQ ID NO: 65464 - RNA, 1701 nt, Artificial Sequence
  derived and/or modified sequence opt1 from hemagglutinin__InfluenzaA__ADE20898
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggagauccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagggggugaagaacggcaccuacgacuaccccaaguacagcgaggaggccaagcugaaccgggaggagaucgacggggucaagcucgaguccacccgcaucuaccagauccuggcgaucuacagcaccguggccuccagccuggugcucgucgugagccugggcgccaucuccuucuggaugugcagcaacggcucccugcagugccggaucugcaucuga

SEQ ID NO: 65465 - RNA, 1701 nt, Artificial Sequence; identical to SEQ ID NO: 65428
  derived and/or modified sequence opt1 from hemagglutinin__InfluenzaA__ADE20908

SEQ ID NO: 65466 - RNA, 1701 nt, Artificial Sequence
  derived and/or modified sequence opt1 from hemagglutinin__InfluenzaA__ADE20918
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggauccugguggagcccggggacaagaucaccuucgaggcgaccggcaaccugguggucccccgguacgccuucgccauggagcgcaacgccggguccggcaucaucaucagcgacacccccgugcacgacugcaacacgaccugccagaccccgaagggcgccaucaacaccucccuccccuuccagaacauccaccccaucacgaucgggaagugccccaaguacgucaagagcaccaagcugcggcuggcgaccggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65467 - RNA, 1701 nt, Artificial Sequence; identical to SEQ ID NO: 64030
  derived and/or modified sequence opt1 from hemagglutinin__InfluenzaA__ADE20928

SEQ ID NO: 65468 - RNA, 1701 nt, Artificial Sequence
  derived and/or modified sequence opt1 from hemagglutinin__InfluenzaA__ADE20948
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65469 - RNA, 1701 nt, Artificial Sequence
  derived and/or modified sequence opt1 from hemagglutinin__InfluenzaA__ADE20968
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgaggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacuccggcgccaagagcuucuacaagaaccugaucuggcucgucaagaaggggaacuccuaccccaagcugagcaagagcuacaucaacgacaagggcaaggaggugcuggugcucugggggauccaccaccccuccaccagcgcggaccagcagucccuguaccagaacgccgacgccuacgucuucgugggcacgagccgguacuccaagaaguucaagcccgagaucgccauccgcccgaaggugcgggaccaggagggccgcaugaacuacuacuggacccuggucgagcccggggacaagaucaccuucgaggccaccggcaaccucguggugccccgguacgcguucgccauggagcgcaacgccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgugccgagcauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacaagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggcgagcucccugguccucguggugagccugggggccaucuccuucuggaugugcagcaacggcucccugcagugccggaucugcaucuga

SEQ ID NO: 65470 - RNA, 1701 nt, Artificial Sequence; identical to SEQ ID NO: 64841
  derived and/or modified sequence opt1 from hemagglutinin__InfluenzaA__ADE20978

SEQ ID NO: 65471 - RNA, 1701 nt, Artificial Sequence
  derived and/or modified sequence opt1 from hemagglutinin__InfluenzaA__ADE20988
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaagcgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 65472 - RNA, 1701 nt, Artificial Sequence; identical to SEQ ID NO: 64841
  derived and/or modified sequence opt1 from hemagglutinin__InfluenzaA__ADE20998

SEQ ID NO: 65473 - RNA, 1701 nt, Artificial Sequence; identical to SEQ ID NO: 65005
  derived and/or modified sequence opt1 from hemagglutinin__InfluenzaA__ADE21008

SEQ ID NO: 65474 - RNA, 1701 nt, Artificial Sequence
  derived and/or modified sequence opt1 from hemagglutinin__InfluenzaA__ADE21018
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccaccgaccagcagagccuguaccagaacgcggacgccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacaucccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcugguccuccuggagaacgagcggacgcuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggccagcagccugguccucguggugucccugggggcgaucagcuucuggaugugcuccaacggcagccugcagugccggaucugcaucuga

SEQ ID NO: 65475 - RNA, 1701 nt, Artificial Sequence; identical to SEQ ID NO: 65415
  derived and/or modified sequence opt1 from hemagglutinin__InfluenzaA__ADE21028

SEQ ID NO: 65476 - RNA, 1701 nt, Artificial Sequence; identical to SEQ ID NO: 65405
  derived and/or modified sequence opt1 from hemagglutinin__InfluenzaA__ADE21038

SEQ ID NO: 65477 - RNA, 1701 nt, Artificial Sequence; identical to SEQ ID NO: 65428
  derived and/or modified sequence opt1 from hemagglutinin__InfluenzaA__ADE21048

SEQ ID NO: 65478 - RNA, 1701 nt, Artificial Sequence
  derived and/or modified sequence opt1 from hemagglutinin__InfluenzaA__ADE21058
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaucaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 65479 - RNA, 1701 nt, Artificial Sequence
  derived and/or modified sequence opt1 from hemagglutinin__InfluenzaA__ADE21068
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaccgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65480 - RNA, 1698 nt, Artificial Sequence
  derived and/or modified sequence opt1 from hemagglutinin__InfluenzaA__ADE28761
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgagagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccauggaggucuaccagauccuggcgaucuacagcaccguggccagcucccuggugcuccuggucagccugggcgccaucuccuucuggaugugcagcaacgggucccuccagugccggaucugcaucuga

SEQ ID NO: 65481 - RNA, 1701 nt, Artificial Sequence; identical to SEQ ID NO: 63857
  derived and/or modified sequence opt1 from hemagglutinin__InfluenzaA__ADE28780

SEQ ID NO: 65482 - RNA, 1701 nt, Artificial Sequence; identical to SEQ ID NO: 65265
  derived and/or modified sequence opt1 from hemagglutinin__InfluenzaA__ADE28790

SEQ ID NO: 65483 - RNA, 1701 nt, Artificial Sequence; identical to SEQ ID NO: 65449
  derived and/or modified sequence opt1 from hemagglutinin__InfluenzaA__ADE28800

SEQ ID NO: 65484 - RNA, 1701 nt, Artificial Sequence; identical to SEQ ID NO: 64841
  derived and/or modified sequence opt1 from hemagglutinin__InfluenzaA__ADE28810

SEQ ID NO: 65485 - RNA, 1701 nt, Artificial Sequence
  derived and/or modified sequence opt1 from hemagglutinin__InfluenzaA__ADE28820
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggagcccggagugcgagucccugagcaccgcguccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65486 - RNA, 1701 nt, Artificial Sequence; identical to SEQ ID NO: 63857
  derived and/or modified sequence opt1 from hemagglutinin__InfluenzaA__ADE28830

SEQ ID NO: 65487 - RNA, 1701 nt, Artificial Sequence; identical to SEQ ID NO: 63857
  derived and/or modified sequence opt1 from hemagglutinin__InfluenzaA__ADE28840

SEQ ID NO: 65488 - RNA, 1701 nt, Artificial Sequence; identical to SEQ ID NO: 63857
  derived and/or modified sequence opt1 from hemagglutinin__InfluenzaA__ADE28850

SEQ ID NO: 65489 - RNA, 1701 nt, Artificial Sequence; identical to SEQ ID NO: 63857
  derived and/or modified sequence opt1 from hemagglutinin__InfluenzaA__ADE28881

SEQ ID NO: 65490 - RNA, 1701 nt, Artificial Sequence; identical to SEQ ID NO: 63857
  derived and/or modified sequence opt1 from hemagglutinin__InfluenzaA__ADE28891

SEQ ID NO: 65491 - RNA, 1701 nt, Artificial Sequence; identical to SEQ ID NO: 65360
  derived and/or modified sequence opt1 from hemagglutinin__InfluenzaA__ADE28911

SEQ ID NO: 65492 - RNA, 1701 nt, Artificial Sequence; identical to SEQ ID NO: 64841
  derived and/or modified sequence opt1 from hemagglutinin__InfluenzaA__ADE28921

SEQ ID NO: 65493 - RNA, 1701 nt, Artificial Sequence; identical to SEQ ID NO: 64841
  derived and/or modified sequence opt1 from hemagglutinin__InfluenzaA__ADE28931

SEQ ID NO: 65494 - RNA, 1701 nt, Artificial Sequence; identical to SEQ ID NO: 64030
  derived and/or modified sequence opt1 from hemagglutinin__InfluenzaA__ADE28951

SEQ ID NO: 65495 - RNA, 1701 nt, Artificial Sequence
  derived and/or modified sequence opt1 from hemagglutinin__InfluenzaA__ADE28961
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacguggccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65496 - RNA, 1701 nt, Artificial Sequence; identical to SEQ ID NO: 65381
  derived and/or modified sequence opt1 from hemagglutinin__InfluenzaA__ADE28971

SEQ ID NO: 65497 - RNA, 1701 nt, Artificial Sequence
  derived and/or modified sequence opt1 from hemagglutinin__InfluenzaA__ADE28981
augaaggccauccuggugguccuccuguacaccuucgccaccgcgaacgccgacacgcugugcaucggcuaccacgccaacaacagcaccgagaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65498 - RNA, 1701 nt, Artificial Sequence; identical to SEQ ID NO: 64841
  derived and/or modified sequence opt1 from hemagglutinin__InfluenzaA__ADE28991

SEQ ID NO: 65499 - RNA, 1701 nt, Artificial Sequence
  derived and/or modified sequence opt1 from hemagglutinin__InfluenzaA__ADE29001
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65500 - RNA, 1701 nt, Artificial Sequence; identical to SEQ ID NO: 63919
  derived and/or modified sequence opt1 from hemagglutinin__InfluenzaA__ADE29011

SEQ ID NO: 65501 - RNA, 1701 nt, Artificial Sequence
  derived and/or modified sequence opt1 from hemagglutinin__InfluenzaA__ADE29021
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccggcagcgacaacggcacgugcuaccccggggacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcacggaccagcagucccuguaccagaacgccgacgccuacgugagcgugggcaccucccgguacagcaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagagcaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 65502 - RNA, 1701 nt, Artificial Sequence; identical to SEQ ID NO: 65326
  derived and/or modified sequence opt1 from hemagglutinin__InfluenzaA__ADE29031

SEQ ID NO: 65503 - RNA, 1701 nt, Artificial Sequence
  derived and/or modified sequence opt1 from hemagglutinin__InfluenzaA__ADE29041
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65504 - RNA, 1701 nt, Artificial Sequence; identical to SEQ ID NO: 65326
  derived and/or modified sequence opt1 from hemagglutinin__InfluenzaA__ADE29051

SEQ ID NO: 65505 - RNA, 1701 nt, Artificial Sequence
  derived and/or modified sequence opt1 from hemagglutinin__InfluenzaA__ADE29085
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccgaggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucguggggagcucccgguacagcaagacguucaagccggagaucgccauccgccccaagguccgggaccgcgagggccggaugaacuacuacuggacccugguggagcccggcgacaagaucaccuucgaggcgaccgggaaccucguggucccccgcuacgccuucgccauggagcggaacgccggcuccgggaucaucaucagcgacacgccggugcacgacugcaacacgaccugccagacccccaagggcgccaucaacaccucccugcccuuccagaacauccaccccaucaccaucggcaagugcccgaaguacgucaagagcaccaagcugcgccucgcgaccgggcugcggaacauccccuccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgcgaggagaucgacggggugaagcucgagagcacccggaucuaccagauccuggcgaucuacuccaccguggccagcagccugguccucguggugucccugggcgccaucagcuucuggaugugcuccaacgggagccugcagugccgcaucugcaucuga

SEQ ID NO: 65506 - RNA, 1701 nt, Artificial Sequence
  derived and/or modified sequence opt1 from hemagglutinin__InfluenzaA__ADE29095
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagacguucaagccggagaucgccauccgccccaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagagcaccaagcugcgccucgcgaccggccugcggaacauccccuccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 65507 - RNA, 1701 nt, Artificial Sequence; identical to SEQ ID NO: 64596
  derived and/or modified sequence opt1 from hemagglutinin__InfluenzaA__ADE34191

SEQ ID NO: 65508 - RNA, 1701 nt, Artificial Sequence; identical to SEQ ID NO: 64596
  derived and/or modified sequence opt1 from hemagglutinin__InfluenzaA__ADE34202

SEQ ID NO: 65509 - RNA, 1701 nt, Artificial Sequence
  derived and/or modified sequence opt1 from hemagglutinin__InfluenzaA__ADE34213
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgccggaaggccuacagcaacugcuaccccuacgacgugccggacuacgcgucccugcgcagccucgucgccuccagcggcacgcuggaguucaacaacgaguccuucaacuggaccggggugacccagaacggcaccagcuccgccugcauccggcgcagcaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcgcaucaccgugagcacgaagcggucccagcagaccgugaucccgaacaucggcagccgcccccggguccgcaacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 65510 - RNA, 1701 nt, Artificial Sequence; identical to SEQ ID NO: 64596
  derived and/or modified sequence opt1 from hemagglutinin__InfluenzaA__ADE34224

SEQ ID NO: 65511 - RNA, 1701 nt, Artificial Sequence
  derived and/or modified sequence opt1 from hemagglutinin__InfluenzaA__ADE34235
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaccacgguguccaccaagcgcagccagcagaccgccaucccgaacaucggcagccggccccgcgugcggaacauccccucccgcaucagcaucuacuggaccaucgucaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggcgugcccccgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 65512 - RNA, 1701 nt, Artificial Sequence; identical to SEQ ID NO: 64596
  derived and/or modified sequence opt1 from hemagglutinin__InfluenzaA__ADE34246

SEQ ID NO: 65513 - RNA, 1701 nt, Artificial Sequence; identical to SEQ ID NO: 64621
  derived and/or modified sequence opt1 from hemagglutinin__InfluenzaA__ADE34257

SEQ ID NO: 65514 - RNA, 1701 nt, Artificial Sequence
  derived and/or modified sequence opt1 from hemagglutinin__InfluenzaA__ADE34268
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgaggugccggacuacgcgagccugcggucccucgucgccagcuccggcacgcuggaguucaacaacgagagcuucaacuggaccggggugacccaggacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 65515 - RNA, 1701 nt, Artificial Sequence
  derived and/or modified sequence opt1 from hemagglutinin__InfluenzaA__ADE45499
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucaagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65516 - RNA, 1701 nt, Artificial Sequence; identical to SEQ ID NO: 64475
  derived and/or modified sequence opt1 from hemagglutinin__InfluenzaA__ADE45501

SEQ ID NO: 65517 - RNA, 1701 nt, Artificial Sequence
  derived and/or modified sequence opt1 from hemagglutinin__InfluenzaA__ADE45503
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcgucuaccagauccuggcgaucuacagcaccguggccuccagccuggugcucgucgugagccugggggccaucuccuucuggaugugcagcaacggcucccugcagugccggaucugcaucuga

SEQ ID NO: 65518 - RNA, 1701 nt, Artificial Sequence; identical to SEQ ID NO: 63677
  derived and/or modified sequence opt1 from hemagglutinin__InfluenzaA__ADE45505

SEQ ID NO: 65519 - RNA, 1701 nt, Artificial Sequence; identical to SEQ ID NO: 64030
  derived and/or modified sequence opt1 from hemagglutinin__InfluenzaA__ADE45507

SEQ ID NO: 65520 - RNA, 1701 nt, Artificial Sequence; identical to SEQ ID NO: 64030
  derived and/or modified sequence opt1 from hemagglutinin__InfluenzaA__ADE45509

SEQ ID NO: 65521 - RNA, 1701 nt, Artificial Sequence; identical to SEQ ID NO: 64475
  derived and/or modified sequence opt1 from hemagglutinin__InfluenzaA__ADE45511

SEQ ID NO: 65522 - RNA, 1701 nt, Artificial Sequence
  derived and/or modified sequence opt1 from hemagglutinin__InfluenzaA__ADE45513
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacgccuucgugggcacgagccgguacuccaagaaguucaagccggagaucgcgauccgccccaaggugcgggaccaggagggccgcaucaacuacuacuggacccuggucgagcccggggacaagaucaucuucgaggccaccggcaaccucguggugccccgguacgccuucgccauggagcgcaacgccgggagcggcaucaucaucuccgacaccccggcgcacgacugcaacacgaccugccagacccccaagggcgccaucaacaccagccugcccuuccagaacauccaccccaucacgaucgggaagugcccgaaguacgucaaguccaccaagcugcggcucgccaccggccugcgcaacgugcccagcauccagucccgggggcuguucggcgccaucgccggguucaucgagggcggcuggaccgggaugguggacggcugguacggguaccaccaccagaacgagcagggcagcggguacgcggccgaccucaaguccacgcagaacgccaucgacgagaucaccaacaaggucaacagcgugaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgucaagaaccucuacgagaaggugcgcagccagcugaagaacaacgcgaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggccuccagccuggugcucgucgugagccugggggcgaucuccuucuggaugugcagcaacggcucccugcagugccggaucugcaucuga

SEQ ID NO: 65523 - RNA, 1701 nt, Artificial Sequence
  derived and/or modified sequence opt1 from hemagglutinin__InfluenzaA__ADE75388
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgagaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65524 - RNA, 1701 nt, Artificial Sequence; identical to SEQ ID NO: 63677
  derived and/or modified sequence opt1 from hemagglutinin__InfluenzaA__ADE75390

SEQ ID NO: 65525 - RNA, 1701 nt, Artificial Sequence; identical to SEQ ID NO: 63677
  derived and/or modified sequence opt1 from hemagglutinin__InfluenzaA__ADF10067

SEQ ID NO: 65526 - RNA, 1701 nt, Artificial Sequence; identical to SEQ ID NO: 63677
  derived and/or modified sequence opt1 from hemagglutinin__InfluenzaA__ADF10077

SEQ ID NO: 65527 - RNA, 1701 nt, Artificial Sequence
  derived and/or modified sequence opt1 from hemagglutinin__InfluenzaA__ADF10087
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccaugaagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65528 - RNA, 1701 nt, Artificial Sequence
  derived and/or modified sequence opt1 from hemagglutinin__InfluenzaA__ADF10097
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccaccaagaucuaccagauccuggcgaucuacagcaccgucgccagcucccuggugcucguggucagccugggggccaucuccuucuggaugugcagcaacggcucccugcagugccggaucugcaucuga

SEQ ID NO: 65529 - RNA, 1701 nt, Artificial Sequence
  derived and/or modified sequence opt1 from hemagglutinin__InfluenzaA__ADF10107
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccacccgcccaccagcgccgaccagcagucccuguaccagaacgccgacgccuacguguucgugggcagcuccaaguacagcaagaaguucaagcccgagaucgccauccggcccaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucagcgacaccccggcccacgacugcaacacgaccugccagacccccaagggcgcgaucaacaccucccugcccuuccacaacauccaccccaucacgaucgggaagugcccgaaguacgucaagagcaccaagcugcgccucgccaccggccugcggaacgugcccuccauccagagccgcgggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgcgaggagaucgacggcgugaagcucgagagcaccaagaucuaccagauccuggccaucuacuccaccguggccagcagccugguccucguggugucccugggggccaucagcuucuggaugugcuccaacggcagccugcagugccggaucugcaucuga

SEQ ID NO: 65530 - RNA, 1701 nt, Artificial Sequence; identical to SEQ ID NO: 63677
  derived and/or modified sequence opt1 from hemagglutinin__InfluenzaA__ADF10117

SEQ ID NO: 65531 - RNA, 1701 nt, Artificial Sequence; identical to SEQ ID NO: 65381
  derived and/or modified sequence opt1 from hemagglutinin__InfluenzaA__ADF10127

SEQ ID NO: 65532 - RNA, 1701 nt, Artificial Sequence; identical to SEQ ID NO: 63677
  derived and/or modified sequence opt1 from hemagglutinin__InfluenzaA__ADF10137

SEQ ID NO: 65533 - RNA, 1701 nt, Artificial Sequence
  derived and/or modified sequence opt1 from hemagglutinin__InfluenzaA__ADF10154
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65534 - RNA, 1701 nt, Artificial Sequence
  derived and/or modified sequence opt1 from hemagglutinin__InfluenzaA__ADF10174
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65535 - RNA, 1701 nt, Artificial Sequence; identical to SEQ ID NO: 65534
  derived and/or modified sequence opt1 from hemagglutinin__InfluenzaA__ADF10190

SEQ ID NO: 65536 - RNA, 1701 nt, Artificial Sequence; identical to SEQ ID NO: 65381
  derived and/or modified sequence opt1 from hemagglutinin__InfluenzaA__ADF10237

SEQ ID NO: 65537 - RNA, 1701 nt, Artificial Sequence; identical to SEQ ID NO: 65534
  derived and/or modified sequence opt1 from hemagglutinin__InfluenzaA__ADF10262

SEQ ID NO: 65538 - RNA, 1701 nt, Artificial Sequence
  derived and/or modified sequence opt1 from hemagglutinin__InfluenzaA__ADF10288
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcgugugcaucuga

SEQ ID NO: 65539 - RNA, 1701 nt, Artificial Sequence; identical to SEQ ID NO: 65381
  derived and/or modified sequence opt1 from hemagglutinin__InfluenzaA__ADF10302

SEQ ID NO: 65540 - RNA, 1701 nt, Artificial Sequence; identical to SEQ ID NO: 65381
  derived and/or modified sequence opt1 from hemagglutinin__InfluenzaA__ADF10335

SEQ ID NO: 65541 - RNA, 1701 nt, Artificial Sequence; identical to SEQ ID NO: 65381
  derived and/or modified sequence opt1 from hemagglutinin__InfluenzaA__ADF10359

SEQ ID NO: 65542 - RNA, 1701 nt, Artificial Sequence; identical to SEQ ID NO: 65534
  derived and/or modified sequence opt1 from hemagglutinin__InfluenzaA__ADF10369

SEQ ID NO: 65543 - RNA, 1701 nt, Artificial Sequence; identical to SEQ ID NO: 65534
  derived and/or modified sequence opt1 from hemagglutinin__InfluenzaA__ADF10390

SEQ ID NO: 65544 - RNA, 1701 nt, Artificial Sequence; identical to SEQ ID NO: 65381
  derived and/or modified sequence opt1 from hemagglutinin__InfluenzaA__ADF10528

SEQ ID NO: 65545 - RNA, 1701 nt, Artificial Sequence; identical to SEQ ID NO: 65534
  derived and/or modified sequence opt1 from hemagglutinin__InfluenzaA__ADF10598

SEQ ID NO: 65546 - RNA, 1701 nt, Artificial Sequence; identical to SEQ ID NO: 65534
  derived and/or modified sequence opt1 from hemagglutinin__InfluenzaA__ADF10670

SEQ ID NO: 65547 - RNA, 1701 nt, Artificial Sequence; identical to SEQ ID NO: 65534
  derived and/or modified sequence opt1 from hemagglutinin__InfluenzaA__ADF10724

SEQ ID NO: 65548 - RNA, 1701 nt, Artificial Sequence; identical to SEQ ID NO: 65381
  derived and/or modified sequence opt1 from hemagglutinin__InfluenzaA__ADF10757

SEQ ID NO: 65549 - RNA, 1701 nt, Artificial Sequence
  derived and/or modified sequence opt1 from hemagglutinin__InfluenzaA__ADF10828
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65550 - RNA, 1701 nt, Artificial Sequence; identical to SEQ ID NO: 63677
  derived and/or modified sequence opt1 from hemagglutinin__InfluenzaA__ADF10874

SEQ ID NO: 65551 - RNA, 1701 nt, Artificial Sequence; identical to SEQ ID NO: 64300
  derived and/or modified sequence opt1 from hemagglutinin__InfluenzaA__ADF10929

SEQ ID NO: 65552 - RNA, 1701 nt, Artificial Sequence; identical to SEQ ID NO: 64300
  derived and/or modified sequence opt1 from hemagglutinin__InfluenzaA__ADF10996

SEQ ID NO: 65553 - RNA, 1701 nt, Artificial Sequence; identical to SEQ ID NO: 63677
  derived and/or modified sequence opt1 from hemagglutinin__InfluenzaA__ADF27367

SEQ ID NO: 65554 - RNA, 1701 nt, Artificial Sequence; identical to SEQ ID NO: 63677
  derived and/or modified sequence opt1 from hemagglutinin__InfluenzaA__ADF27369

SEQ ID NO: 65555 - RNA, 1701 nt, Artificial Sequence
  derived and/or modified sequence opt1 from hemagglutinin__InfluenzaA__ADF27370
augaaggccauccuggugauccuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacguccuggugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65556 - RNA, 1701 nt, Artificial Sequence; identical to SEQ ID NO: 64849
  derived and/or modified sequence opt1 from hemagglutinin__InfluenzaA__ADF27371

SEQ ID NO: 65557 - RNA, 1701 nt, Artificial Sequence
  derived and/or modified sequence opt1 from hemagglutinin__InfluenzaA__ADF27372
augaaggccauccuggugguccuccuguacaccuucgccaccgcgaacgccgacacgcugugcaucggcuaccacaccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65558 - RNA, 1701 nt, Artificial Sequence
  derived and/or modified sequence opt1 from hemagglutinin__InfluenzaA__ADF27373
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcucaucgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcgccucgcgaccggccugcggaacgucccgagcauccagacccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65559 - RNA, 1701 nt, Artificial Sequence; identical to SEQ ID NO: 63919
  derived and/or modified sequence opt1 from hemagglutinin__InfluenzaA__ADF27374

SEQ ID NO: 65560 - RNA, 1701 nt, Artificial Sequence
  derived and/or modified sequence opt1 from hemagglutinin__InfluenzaA__ADF27375
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccagaaguccacgcagaacgcgaucgacgagaucaccaacaagaucaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgcgaucuacagcaccguggccagcucccugguccugguggugagccucggggccaucuccuucuggaugugcagcaacggcucccugcagugccggaucugcaucuga

SEQ ID NO: 65561 - RNA, 1701 nt, Artificial Sequence
  derived and/or modified sequence opt1 from hemagglutinin__InfluenzaA__ADF27376
augaaggccauccuggugguccuccuguacaccuucgugaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccaacagcgacaacggcacgugcuaccccggcgacuucaucgacuacgaggagcuccgggagcagcuguccagcgucuccagcuucgagcgcuucgagaucuuccccaagaccuccagcuggcccaaccacgacuccaacaagggggugaccgccgccugcccgcacgccggcgccaagagcuucuacaagaaccugaucuggcucgugaagaaggggaacuccuaccccaagcugagcaaguccuacaucaacgacaagggcaaggagguccuggugcucugggggauccaccaccccagcaccagcgcggaccagcagucccuguaccagaacgccgacgccuacguguucgucggcacgagccgguacuccaagaaguucaagcccgagaucgagauccgcccgaaggugcgggaccaggagggccgcaugaacuacuacuggacccugguggagcccggggacaagaucaccuucgaggccaccggcaaccucgucgugccccgguacgccuucgcgauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcugcggcucgccaccggccugcgcaacgugccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggccuccagccuggugcucgucgugagccugggggcgaucuccuucuggaugugcagcaacggcucccugcagugccggaucugcaucuga

SEQ ID NO: 65562 - RNA, 1701 nt, Artificial Sequence
  derived and/or modified sequence opt1 from hemagglutinin__InfluenzaA__ADF27378
augaaggccauccuggugguccuccuguacaccuucgugaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccaacagcgacaacggcacgugcuaccccggcgacuucaucgacuacgaggagcuccgggagcagcuguccagcgucuccagcuucgagcgcuucgagaucuuccccaagaccuccagcuggcccaaccacgacuccaacaagggggugaccgccgccugcccgcacgccggcgccaagagcuucuacaagaaccugaucuggcucgugaagaaggggaacuccuaccccaagcugagcaaguccuacaucaacgacaagggcaaggagguccuggugcucugggggauccaccaccccagcaccagcgcggaccagcagucccuguaccagaacgccgacgccuacguguucgucggcacgagccgguacuccaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcugcggcucgccaccggccugcgcaacgugccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggucaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcguccagccuggugcucgucgugagccugggggccaucuccuucuggaugugcagcaacggcucccugcagugccggaucugcaucuga

SEQ ID NO: 65563 - RNA, 1701 nt, Artificial Sequence
  derived and/or modified sequence opt1 from hemagglutinin__InfluenzaA__ADF27389
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucacgagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65564 - RNA, 1701 nt, Artificial Sequence
  derived and/or modified sequence opt1 from hemagglutinin__InfluenzaA__ADF27399
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65565 - RNA, 1701 nt, Artificial Sequence; identical to SEQ ID NO: 64841
  derived and/or modified sequence opt1 from hemagglutinin__InfluenzaA__ADF27409

SEQ ID NO: 65566 - RNA, 1701 nt, Artificial Sequence; identical to SEQ ID NO: 65549
  derived and/or modified sequence opt1 from hemagglutinin__InfluenzaA__ADF27419

SEQ ID NO: 65567 - RNA, 1701 nt, Artificial Sequence
  derived and/or modified sequence opt1 from hemagglutinin__InfluenzaA__ADF27429
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaaguucuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaugaaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65568 - RNA, 1701 nt, Artificial Sequence; identical to SEQ ID NO: 63677
  derived and/or modified sequence opt1 from hemagglutinin__InfluenzaA__ADF27439

SEQ ID NO: 65569 - RNA, 1701 nt, Artificial Sequence
  derived and/or modified sequence opt1 from hemagglutinin__InfluenzaA__ADF27449
augaaggccauccuggugguccuccuguacaccuucgccaccgugaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacaucccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65570 - RNA, 1701 nt, Artificial Sequence; identical to SEQ ID NO: 64837
  derived and/or modified sequence opt1 from hemagglutinin__InfluenzaA__ADF27459

SEQ ID NO: 65571 - RNA, 1701 nt, Artificial Sequence; identical to SEQ ID NO: 63677
  derived and/or modified sequence opt1 from hemagglutinin__InfluenzaA__ADF27469

SEQ ID NO: 65572 - RNA, 1701 nt, Artificial Sequence
  derived and/or modified sequence opt1 from hemagglutinin__InfluenzaA__ADF27479
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccacagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65573 - RNA, 1701 nt, Artificial Sequence
  derived and/or modified sequence opt1 from hemagglutinin__InfluenzaA__ADF27489
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65574 - RNA, 1701 nt, Artificial Sequence; identical to SEQ ID NO: 64841
  derived and/or modified sequence opt1 from hemagglutinin__InfluenzaA__ADF27499

SEQ ID NO: 65575 - RNA, 1701 nt, Artificial Sequence; identical to SEQ ID NO: 63677
  derived and/or modified sequence opt1 from hemagglutinin__InfluenzaA__ADF27509

SEQ ID NO: 65576 - RNA, 1701 nt, Artificial Sequence; identical to SEQ ID NO: 65274
  derived and/or modified sequence opt1 from hemagglutinin__InfluenzaA__ADF27529

SEQ ID NO: 65577 - RNA, 1701 nt, Artificial Sequence; identical to SEQ ID NO: 64849
  derived and/or modified sequence opt1 from hemagglutinin__InfluenzaA__ADF27539

SEQ ID NO: 65578 - RNA, 1701 nt, Artificial Sequence; identical to SEQ ID NO: 64849
  derived and/or modified sequence opt1 from hemagglutinin__InfluenzaA__ADF27549

SEQ ID NO: 65579 - RNA, 1701 nt, Artificial Sequence; identical to SEQ ID NO: 63677
  derived and/or modified sequence opt1 from hemagglutinin__InfluenzaA__ADF27559

SEQ ID NO: 65580 - RNA, 1701 nt, Artificial Sequence
  derived and/or modified sequence opt1 from hemagglutinin__InfluenzaA__ADF27569
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcgugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65581 - RNA, 1701 nt, Artificial Sequence; identical to SEQ ID NO: 64849
  derived and/or modified sequence opt1 from hemagglutinin__InfluenzaA__ADF27579

SEQ ID NO: 65582 - RNA, 1701 nt, Artificial Sequence
  derived and/or modified sequence opt1 from hemagglutinin__InfluenzaA__ADF27589
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacguccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65583 - RNA, 1701 nt, Artificial Sequence
  derived and/or modified sequence opt1 from hemagglutinin__InfluenzaA__ADF27599
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcucaagagcaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65584 - RNA, 1701 nt, Artificial Sequence
  derived and/or modified sequence opt1 from hemagglutinin__InfluenzaA__ADF27609
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65585 - RNA, 1701 nt, Artificial Sequence
  derived and/or modified sequence opt1 from hemagglutinin__InfluenzaA__ADF27619
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgcggccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 65586 - RNA, 1701 nt, Artificial Sequence; identical to SEQ ID NO: 64849
  derived and/or modified sequence opt1 from hemagglutinin__InfluenzaA__ADF27629

SEQ ID NO: 65587 - RNA, 1701 nt, Artificial Sequence
  derived and/or modified sequence opt1 from hemagglutinin__InfluenzaA__ADF27649
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagccccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65588 - RNA, 1701 nt, Artificial Sequence; identical to SEQ ID NO: 64849
  derived and/or modified sequence opt1 from hemagglutinin__InfluenzaA__ADF27659

SEQ ID NO: 65589 - RNA, 1701 nt, Artificial Sequence; identical to SEQ ID NO: 65326
  derived and/or modified sequence opt1 from hemagglutinin__InfluenzaA__ADF27669

SEQ ID NO: 65590 - RNA, 1701 nt, Artificial Sequence; identical to SEQ ID NO: 64778
  derived and/or modified sequence opt1 from hemagglutinin__InfluenzaA__ADF27679

SEQ ID NO: 65591 - RNA, 1701 nt, Artificial Sequence; identical to SEQ ID NO: 65387
  derived and/or modified sequence opt1 from hemagglutinin__InfluenzaA__ADF27689

SEQ ID NO: 65592 - RNA, 1701 nt, Artificial Sequence
  derived and/or modified sequence opt1 from hemagglutinin__InfluenzaA__ADF27699
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65593 - RNA, 1701 nt, Artificial Sequence
  derived and/or modified sequence opt1 from hemagglutinin__InfluenzaA__ADF27709
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaucuccagcuccgacaacgggaccugcuaccccggcgacuucaucaacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65594 - RNA, 1701 nt, Artificial Sequence; identical to SEQ ID NO: 64841
  derived and/or modified sequence opt1 from hemagglutinin__InfluenzaA__ADF27785

SEQ ID NO: 65595 - RNA, 1701 nt, Artificial Sequence
  derived and/or modified sequence opt1 from hemagglutinin__InfluenzaA__ADF27795
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65596 - RNA, 1701 nt, Artificial Sequence; identical to SEQ ID NO: 64849
  derived and/or modified sequence opt1 from hemagglutinin__InfluenzaA__ADF27805

SEQ ID NO: 65597 - RNA, 1701 nt, Artificial Sequence
  derived and/or modified sequence opt1 from hemagglutinin__InfluenzaA__ADF27815
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgacggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65598 - RNA, 1701 nt, Artificial Sequence
  derived and/or modified sequence opt1 from hemagglutinin__InfluenzaA__ADF27825
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacagcgaggagcuccgcgagcagcuguccagcguguccagcuucgagcgguucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 65599 - RNA, 1701 nt, Artificial Sequence
  derived and/or modified sequence opt1 from hemagglutinin__InfluenzaA__ADF27845
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccaacgccgaccagcagucccuguaccagaacgccgacgccuacgucuucgugggcacgagccgguacuccaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccgggagcggcaucaucaucuccgacacgcccguccacgacugcaacacgaccugccagaccccgaagggcgcgaucaacaccagccugcccuuccagaacauccaccccaucaccaucgggaagugccccaaguacgugaaguccaccaagcugcggcucgccaccggccugcgcaacgugccgagcauccagucccgggggcuguucggcgccaucgccggguucaucgagggcggcuggacggggauggucgacggcugguacggguaccaccaccagaacgagcagggcagcggguacgccgcggaccucaaguccacccagaacgccaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgggaggagaucgacggcgugaagcucgaguccacccgcaucuaccagauccuggccaucuacagcaccguggccuccagccugguccucguggugagccugggggccaucuccuucuggaugugcagcaacggcucccugcagugccggaucugcaucuga

SEQ ID NO: 65600 - RNA, 1701 nt, Artificial Sequence; identical to SEQ ID NO: 64841
  derived and/or modified sequence opt1 from hemagglutinin__InfluenzaA__ADF27855

SEQ ID NO: 65601 - RNA, 1701 nt, Artificial Sequence; identical to SEQ ID NO: 64841
  derived and/or modified sequence opt1 from hemagglutinin__InfluenzaA__ADF27865

SEQ ID NO: 65602 - RNA, 1701 nt, Artificial Sequence; identical to SEQ ID NO: 64841
  derived and/or modified sequence opt1 from hemagglutinin__InfluenzaA__ADF27875

SEQ ID NO: 65603 - RNA, 1701 nt, Artificial Sequence; identical to SEQ ID NO: 64841
  derived and/or modified sequence opt1 from hemagglutinin__InfluenzaA__ADF27885

SEQ ID NO: 65604 - RNA, 1701 nt, Artificial Sequence; identical to SEQ ID NO: 63677
  derived and/or modified sequence opt1 from hemagglutinin__InfluenzaA__ADF27895

SEQ ID NO: 65605 - RNA, 1701 nt, Artificial Sequence
  derived and/or modified sequence opt1 from hemagglutinin__InfluenzaA__ADF27915
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcgccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 65606 - RNA, 1701 nt, Artificial Sequence
  derived and/or modified sequence opt1 from hemagglutinin__InfluenzaA__ADF27925
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaacagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggauggccaccggccuccgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcuggagagcacccgcaucuaccagauccucgccaucuacuccaccguggccagcagccugguccugguggugucccucggggccaucagcuucuggaugugcuccaacggcagccugcagugccggaucugcaucuga

SEQ ID NO: 65607 - RNA, 1701 nt, Artificial Sequence
  derived and/or modified sequence opt1 from hemagglutinin__InfluenzaA__ADF27935
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccgaagugcgagagccuguccaccgagagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65608 - RNA, 1701 nt, Artificial Sequence
  derived and/or modified sequence opt1 from hemagglutinin__InfluenzaA__ADF27955
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaacagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65609 - RNA, 1701 nt, Artificial Sequence
  derived and/or modified sequence opt1 from hemagglutinin__InfluenzaA__ADF27965
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaagaaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugaacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65610 - RNA, 1701 nt, Artificial Sequence; identical to SEQ ID NO: 64841
  derived and/or modified sequence opt1 from hemagglutinin__InfluenzaA__ADF27975

SEQ ID NO: 65611 - RNA, 1701 nt, Artificial Sequence; identical to SEQ ID NO: 64849
  derived and/or modified sequence opt1 from hemagglutinin__InfluenzaA__ADF27985

SEQ ID NO: 65612 - RNA, 1701 nt, Artificial Sequence
  derived and/or modified sequence opt1 from hemagglutinin__InfluenzaA__ADF27995
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccaacgccgaccagcagucccuguaccagaacgccgacgccuacgucuucgugggcacgagccgguacuccaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccgggagcggcaucaucaucuccgacacgcccgcgcacgacugcaacacgaccugccagaccccgaagggcgccaucaacaccagccugcccuuccagaacauccaccccaucaccaucgggaagugccccaaguacgucaaguccaccaagcugcggcucgccaccggccugcgcaacaucccgagcauccagucccgggggcuguucggcgccaucgccggguucaucgagggcggcuggacggggaugguggacggcugguacggguaccaccaccagaacgagcagggcagcggguacgcggccgaccucaaguccacccagaacgccaucgacgagaucaccaacaaggugaacagcgucaucgagaagaugaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaagguccgcagccagcugaagaacaacgcgaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgccuccagccuggugcucguggucagccugggggcgaucuccuucuggaugugcagcaacggcucccugcagugccggaucugcaucuga

SEQ ID NO: 65613 - RNA, 1701 nt, Artificial Sequence; identical to SEQ ID NO: 65229
  derived and/or modified sequence opt1 from hemagglutinin__InfluenzaA__ADF28005

SEQ ID NO: 65614 - RNA, 1701 nt, Artificial Sequence; identical to SEQ ID NO: 65229
  derived and/or modified sequence opt1 from hemagglutinin__InfluenzaA__ADF28015

SEQ ID NO: 65615 - RNA, 1701 nt, Artificial Sequence; identical to SEQ ID NO: 64841
  derived and/or modified sequence opt1 from hemagglutinin__InfluenzaA__ADF28025

SEQ ID NO: 65616 - RNA, 1701 nt, Artificial Sequence; identical to SEQ ID NO: 64841
  derived and/or modified sequence opt1 from hemagglutinin__InfluenzaA__ADF28045

SEQ ID NO: 65617 - RNA, 1701 nt, Artificial Sequence
  derived and/or modified sequence opt1 from hemagglutinin__InfluenzaA__ADF28055
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaacuacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65618 - RNA, 1701 nt, Artificial Sequence; identical to SEQ ID NO: 64841
  derived and/or modified sequence opt1 from hemagglutinin__InfluenzaA__ADF28065

SEQ ID NO: 65619 - RNA, 1701 nt, Artificial Sequence; identical to SEQ ID NO: 63859
  derived and/or modified sequence opt1 from hemagglutinin__InfluenzaA__ADF28075

SEQ ID NO: 65620 - RNA, 1701 nt, Artificial Sequence; identical to SEQ ID NO: 64778
  derived and/or modified sequence opt1 from hemagglutinin__InfluenzaA__ADF28085

SEQ ID NO: 65621 - RNA, 1701 nt, Artificial Sequence; identical to SEQ ID NO: 63857
  derived and/or modified sequence opt1 from hemagglutinin__InfluenzaA__ADF28107

SEQ ID NO: 65622 - RNA, 1701 nt, Artificial Sequence; identical to SEQ ID NO: 65229
  derived and/or modified sequence opt1 from hemagglutinin__InfluenzaA__ADF28117

SEQ ID NO: 65623 - RNA, 1701 nt, Artificial Sequence
  derived and/or modified sequence opt1 from hemagglutinin__InfluenzaA__ADF29918
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccggagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcaaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65624 - RNA, 1701 nt, Artificial Sequence
  derived and/or modified sequence opt1 from hemagglutinin__InfluenzaA__ADF42689
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucgccgugucccugggggccaucggcuucuggaugugcagcaacggcucccugcagugccggaucugcaucuga

SEQ ID NO: 65625 - RNA, 1701 nt, Artificial Sequence
  derived and/or modified sequence opt1 from hemagglutinin__InfluenzaA__ADF42699
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggacccucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagauguuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65626 - RNA, 1701 nt, Artificial Sequence; identical to SEQ ID NO: 64841
  derived and/or modified sequence opt1 from hemagglutinin__InfluenzaA__ADF42709

SEQ ID NO: 65627 - RNA, 1701 nt, Artificial Sequence; identical to SEQ ID NO: 64841
  derived and/or modified sequence opt1 from hemagglutinin__InfluenzaA__ADF42719

SEQ ID NO: 65628 - RNA, 1701 nt, Artificial Sequence; identical to SEQ ID NO: 64841
  derived and/or modified sequence opt1 from hemagglutinin__InfluenzaA__ADF42729

SEQ ID NO: 65629 - RNA, 1701 nt, Artificial Sequence; identical to SEQ ID NO: 64841
  derived and/or modified sequence opt1 from hemagglutinin__InfluenzaA__ADF42739

SEQ ID NO: 65630 - RNA, 1701 nt, Artificial Sequence
  derived and/or modified sequence opt1 from hemagglutinin__InfluenzaA__ADF58349
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65631 - RNA, 1701 nt, Artificial Sequence; identical to SEQ ID NO: 65274
  derived and/or modified sequence opt1 from hemagglutinin__InfluenzaA__ADF58351

SEQ ID NO: 65632 - RNA, 1701 nt, Artificial Sequence
  derived and/or modified sequence opt1 from hemagglutinin__InfluenzaA__ADF80454
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccaucaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacgacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65633 - RNA, 1701 nt, Artificial Sequence
  derived and/or modified sequence opt1 from hemagglutinin__InfluenzaA__ADF80462
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaucuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcaccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65634 - RNA, 1701 nt, Artificial Sequence; identical to SEQ ID NO: 63677
  derived and/or modified sequence opt1 from hemagglutinin__InfluenzaA__ADF80470

SEQ ID NO: 65635 - RNA, 1701 nt, Artificial Sequence
  derived and/or modified sequence opt1 from hemagglutinin__InfluenzaA__ADF80478
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucauggugccccgguacgccuucgccauggagcgcaacgccgggagcggcaucaucaucuccgacacgccgguccacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 65636 - RNA, 1701 nt, Artificial Sequence
  derived and/or modified sequence opt1 from hemagglutinin__InfluenzaA__ADF80494
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaccaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65637 - RNA, 1701 nt, Artificial Sequence; identical to SEQ ID NO: 65636
  derived and/or modified sequence opt1 from hemagglutinin__InfluenzaA__ADF80498

SEQ ID NO: 65638 - RNA, 1701 nt, Artificial Sequence; identical to SEQ ID NO: 64301
  derived and/or modified sequence opt1 from hemagglutinin__InfluenzaA__ADF80502

SEQ ID NO: 65639 - RNA, 1701 nt, Artificial Sequence
  derived and/or modified sequence opt1 from hemagglutinin__InfluenzaA__ADF80506
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcagcaucgccggcuggauccuggggaacccggagugcgagucccugagcaccgccuccagcugguccuacaucguggagaccagcuccagcgacaacggcacgugcuaccccggcgacuucaucgacuacgaggagcuccgcgagcagcuguccagcguguccagcuucgagcgguucgagaucuuccccaagaccuccagcuggcccaaccacgacccgaacaagggggucaccgccgccugcccccacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgcuacagcaagaaguucaagccggagaucgccauccggcccaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgccggugcacgacugcaacacgaccugccagacccccaagggcgccaucaacaccucccugcccuuccagaacauccaccccaucaccaucggcaagugcccgaaguacgucaagagcaccaagcugcgccucgcgaccgggcugcggaacgugcccuccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacgggagccugcagugccgcaucugcaucuga

SEQ ID NO: 65640 - RNA, 1701 nt, Artificial Sequence
  derived and/or modified sequence opt1 from hemagglutinin__InfluenzaA__ADF83741
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcgugaugcgguccgacgcccccaucggcaagugcaacagcgacugcaucacgcccaacggcuccauccccaacgacaagccguuccagaacgugaaccgcaucaccuacggggcgugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 65641 - RNA, 1701 nt, Artificial Sequence; identical to SEQ ID NO: 64419
  derived and/or modified sequence opt1 from hemagglutinin__InfluenzaA__ADF83752

SEQ ID NO: 65642 - RNA, 1701 nt, Artificial Sequence; identical to SEQ ID NO: 65229
  derived and/or modified sequence opt1 from hemagglutinin__InfluenzaA__ADF83763

SEQ ID NO: 65643 - RNA, 1701 nt, Artificial Sequence; identical to SEQ ID NO: 65229
  derived and/or modified sequence opt1 from hemagglutinin__InfluenzaA__ADF83773

SEQ ID NO: 65644 - RNA, 1701 nt, Artificial Sequence
  derived and/or modified sequence opt1 from hemagglutinin__InfluenzaA__ADF83783
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaccaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65645 - RNA, 1701 nt, Artificial Sequence; identical to SEQ ID NO: 65304
  derived and/or modified sequence opt1 from hemagglutinin__InfluenzaA__ADF83793

SEQ ID NO: 65646 - RNA, 1701 nt, Artificial Sequence
  derived and/or modified sequence opt1 from hemagglutinin__InfluenzaA__ADF83803
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgcguccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcacgagcgccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacgugcaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagacggggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 65647 - RNA, 1701 nt, Artificial Sequence
  derived and/or modified sequence opt1 from hemagglutinin__InfluenzaA__ADF83813
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65648 - RNA, 1701 nt, Artificial Sequence
  derived and/or modified sequence opt1 from hemagglutinin__InfluenzaA__ADF83823
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacaucccgagcauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggcgagcucccugguccucguggugagccugggggccaucuccuucuggaugugcagcaacggcucccugcagugccggaucugcaucuga

SEQ ID NO: 65649 - RNA, 1701 nt, Artificial Sequence; identical to SEQ ID NO: 65229
  derived and/or modified sequence opt1 from hemagglutinin__InfluenzaA__ADF83833

SEQ ID NO: 65650 - RNA, 1701 nt, Artificial Sequence; identical to SEQ ID NO: 65229
  derived and/or modified sequence opt1 from hemagglutinin__InfluenzaA__ADF83843

SEQ ID NO: 65651 - RNA, 1701 nt, Artificial Sequence; identical to SEQ ID NO: 65229
  derived and/or modified sequence opt1 from hemagglutinin__InfluenzaA__ADF83853

SEQ ID NO: 65652 - RNA, 1701 nt, Artificial Sequence
  derived and/or modified sequence opt1 from hemagglutinin__InfluenzaA__ADF83873
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcacggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 65653 - RNA, 1701 nt, Artificial Sequence; identical to SEQ ID NO: 64841
  derived and/or modified sequence opt1 from hemagglutinin__InfluenzaA__ADF83885

SEQ ID NO: 65654 - RNA, 1701 nt, Artificial Sequence
  derived and/or modified sequence opt1 from hemagglutinin__InfluenzaA__ADF83895
augaaggccauccuggugguccuccuguacaccuucgccaccgugaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaagauccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65655 - RNA, 1701 nt, Artificial Sequence; identical to SEQ ID NO: 65229
  derived and/or modified sequence opt1 from hemagglutinin__InfluenzaA__ADF83915

SEQ ID NO: 65656 - RNA, 1701 nt, Artificial Sequence
  derived and/or modified sequence opt1 from hemagglutinin__InfluenzaA__ADF84441
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccagccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacauccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65657 - RNA, 1701 nt, Artificial Sequence; identical to SEQ ID NO: 64841
  derived and/or modified sequence opt1 from hemagglutinin__InfluenzaA__ADF84459

SEQ ID NO: 65658 - RNA, 1701 nt, Artificial Sequence; identical to SEQ ID NO: 65229
  derived and/or modified sequence opt1 from hemagglutinin__InfluenzaA__ADF84469

SEQ ID NO: 65659 - RNA, 1701 nt, Artificial Sequence; identical to SEQ ID NO: 65290
  derived and/or modified sequence opt1 from hemagglutinin__InfluenzaA__ADF84479

SEQ ID NO: 65660 - RNA, 1701 nt, Artificial Sequence; identical to SEQ ID NO: 65229
  derived and/or modified sequence opt1 from hemagglutinin__InfluenzaA__ADF84489

SEQ ID NO: 65661 - RNA, 1701 nt, Artificial Sequence; identical to SEQ ID NO: 65229
  derived and/or modified sequence opt1 from hemagglutinin__InfluenzaA__ADF85017

SEQ ID NO: 65662 - RNA, 1701 nt, Artificial Sequence; identical to SEQ ID NO: 65229
  derived and/or modified sequence opt1 from hemagglutinin__InfluenzaA__ADF87152

SEQ ID NO: 65663 - RNA, 1701 nt, Artificial Sequence
  derived and/or modified sequence opt1 from hemagglutinin__InfluenzaA__ADF87162
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagcaaguacuccaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 65664 - RNA, 1701 nt, Artificial Sequence; identical to SEQ ID NO: 65229
  derived and/or modified sequence opt1 from hemagglutinin__InfluenzaA__ADF87172

SEQ ID NO: 65665 - RNA, 1701 nt, Artificial Sequence
  derived and/or modified sequence opt1 from hemagglutinin__InfluenzaA__ADF87182
augaacgccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuaccacuggacccucgucgagcccggggacaagaucaccuucgaggcgaccggcaaccugguggugccccgguacgccuucgccauggagcgcaacgccggguccggcaucaucaucagcgacgcccccguccacgacugcaacacgaccugccagaccccgaagggcgcgaucaacaccucccugcccuuccagaacauccaccccaucacgaucgggaagugccccaaguacgucaagagcaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaagaucaacuccgugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgggaggagaucgacggcgucaagcuggagagcacccgcaucuaccagauccuggccaucuacuccaccguggccagcagccucgugcuggucgugucccugggggccaucagcuucuggaugugcuccaacggcagccuccagugccggaucugcaucuga

SEQ ID NO: 65666 - RNA, 1701 nt, Artificial Sequence; identical to SEQ ID NO: 65229
  derived and/or modified sequence opt1 from hemagglutinin__InfluenzaA__ADF87192

SEQ ID NO: 65667 - RNA, 1701 nt, Artificial Sequence
  derived and/or modified sequence opt1 from hemagglutinin__InfluenzaA__ADF87202
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguucgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65668 - RNA, 1701 nt, Artificial Sequence; identical to SEQ ID NO: 65229
  derived and/or modified sequence opt1 from hemagglutinin__InfluenzaA__ADF87212

SEQ ID NO: 65669 - RNA, 1701 nt, Artificial Sequence; identical to SEQ ID NO: 65392
  derived and/or modified sequence opt1 from hemagglutinin__InfluenzaA__ADF87232

SEQ ID NO: 65670 - RNA, 1701 nt, Artificial Sequence; identical to SEQ ID NO: 65229
  derived and/or modified sequence opt1 from hemagglutinin__InfluenzaA__ADF87242

SEQ ID NO: 65671 - RNA, 1701 nt, Artificial Sequence
  derived and/or modified sequence opt1 from hemagglutinin__InfluenzaA__ADF87252
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagggcaagagcuaccccaagcuguccaagagcuacaucaacgacaaggggaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65672 - RNA, 1701 nt, Artificial Sequence; identical to SEQ ID NO: 65229
  derived and/or modified sequence opt1 from hemagglutinin__InfluenzaA__ADF87262

SEQ ID NO: 65673 - RNA, 1701 nt, Artificial Sequence; identical to SEQ ID NO: 64841
  derived and/or modified sequence opt1 from hemagglutinin__InfluenzaA__ADF87272

SEQ ID NO: 65674 - RNA, 1701 nt, Artificial Sequence; identical to SEQ ID NO: 64841
  derived and/or modified sequence opt1 from hemagglutinin__InfluenzaA__ADF87282

SEQ ID NO: 65675 - RNA, 1701 nt, Artificial Sequence
  derived and/or modified sequence opt1 from hemagglutinin__InfluenzaA__ADF87292
augaaggccauccuggugguccuccuguacaccuucgccaccgcgaacgccgacacgcugugcaucggcuaccacgccaacaacagcaccgacaccguggacaccgugcucaagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgggcagcugguccuacaucguggagaccagcuccagcgacaacggcacgugcuaccccggggacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacaugugcauggaguccgugaagaacggcaccuacgacuaccccaaguacagcgaggaggccaagcugaaccgggaggagaucgacggggugaagcucgaguccacgcgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65676 - RNA, 1701 nt, Artificial Sequence; identical to SEQ ID NO: 64841
  derived and/or modified sequence opt1 from hemagglutinin__InfluenzaA__ADF87302

SEQ ID NO: 65677 - RNA, 1701 nt, Artificial Sequence
  derived and/or modified sequence opt1 from hemagglutinin__InfluenzaA__ADF87331
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaaggggaucaccgccgccugcccgcacgccggcgccaagagcuucuacaagaaccugaucuggcucgucaagaaggggaacuccuaccccaagcugagcaaguccuacaucaacgacaagggcaaggaggugcuggugcucugggggauccaccaccccagcaccagcgccgaccagcagucccuguaccagaacgccgacgccuacgucuucgugggcagcucccgguacagcaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccggguccggcaucaucaucagcgacacccccguccacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65678 - RNA, 1701 nt, Artificial Sequence; identical to SEQ ID NO: 63677
  derived and/or modified sequence opt1 from hemagglutinin__InfluenzaA__ADF87341

SEQ ID NO: 65679 - RNA, 1701 nt, Artificial Sequence
  derived and/or modified sequence opt1 from hemagglutinin__InfluenzaA__ADF87351
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgacagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65680 - RNA, 1701 nt, Artificial Sequence; identical to SEQ ID NO: 65304
  derived and/or modified sequence opt1 from hemagglutinin__InfluenzaA__ADF87361

SEQ ID NO: 65681 - RNA, 1701 nt, Artificial Sequence; identical to SEQ ID NO: 64841
  derived and/or modified sequence opt1 from hemagglutinin__InfluenzaA__ADF87371

SEQ ID NO: 65682 - RNA, 1701 nt, Artificial Sequence
  derived and/or modified sequence opt1 from hemagglutinin__InfluenzaA__ADG08115
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggggcaggagggccgcaugaacuacuacuggacccugguggagcccggggacaagaucaccuucgaggcgaccggcaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggcuucaucgagggcggguggacggggaugguggacggcugguacggguaccaccaccagaacgagcagggcuccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65683 - RNA, 1701 nt, Artificial Sequence; identical to SEQ ID NO: 64419
  derived and/or modified sequence opt1 from hemagglutinin__InfluenzaA__ADG21004

SEQ ID NO: 65684 - RNA, 1701 nt, Artificial Sequence; identical to SEQ ID NO: 64419
  derived and/or modified sequence opt1 from hemagglutinin__InfluenzaA__ADG21006

SEQ ID NO: 65685 - RNA, 1701 nt, Artificial Sequence
  derived and/or modified sequence opt1 from hemagglutinin__InfluenzaA__ADG21008
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcagcaaguccuacagcaacugcuaccccuacgacgugccggacuacgccucccugcggagccuggucgcguccagcggcacgcucgaguucaacaacgaguccuucaacuggaccggggugacccagaacggcaccagcuccgccugcauccgcaagagcaacaacuccuucuucagccggcugaacuggcugacgcaccucaaguucaaguaccccgcccugaacgugaccaugcccaacaacgagcaguucgacaagcuguacaucuggggcguccaccaccccgggaccgacaacgaccagaucuuccucuacgcccaggcguccgggcgcaucaccgugagcacgaagcggagccagcagaccgugaucccgaacaucggcucccgcccccggguccgcaacauccccagccggaucuccaucuacuggaccaucgugaagcccggcgacauccugcugaucaacagcaccgggaaccucaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcuggccaccggcaugcggaacgugcccgagaagcagacgcgcgggaucuucggcgcgaucgccggguucaucgagaacggcugggagggcaugguggacgggugguacggcuuccggcaccagaacuccgaggggcgcggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgccugcaucgggagcauccgcaacggcaccuacgaccacgacgucuaccgcgacgaggcgcugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 65686 - RNA, 1701 nt, Artificial Sequence
  derived and/or modified sequence opt1 from hemagglutinin__InfluenzaA__ADG21009
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 65687 - RNA, 1701 nt, Artificial Sequence; identical to SEQ ID NO: 64419
  derived and/or modified sequence opt1 from hemagglutinin__InfluenzaA__ADG21010

SEQ ID NO: 65688 - RNA, 1701 nt, Artificial Sequence
  derived and/or modified sequence opt1 from hemagglutinin__InfluenzaA__ADG21011
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccgggacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 65689 - RNA, 1701 nt, Artificial Sequence; identical to SEQ ID NO: 64419
  derived and/or modified sequence opt1 from hemagglutinin__InfluenzaA__ADG21012

SEQ ID NO: 65690 - RNA, 1701 nt, Artificial Sequence; identical to SEQ ID NO: 64419
  derived and/or modified sequence opt1 from hemagglutinin__InfluenzaA__ADG21013

SEQ ID NO: 65691 - RNA, 1701 nt, Artificial Sequence
  derived and/or modified sequence opt1 from hemagglutinin__InfluenzaA__ADG21014
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccucaaguccacgcaggccgccaucgaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 65692 - RNA, 1701 nt, Artificial Sequence
  derived and/or modified sequence opt1 from hemagglutinin__InfluenzaA__ADG21017
augaagaccaucaucgcccugagcuacauccucuaccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcgggcggaucaccgucuccacgaagcgcagccagcaggccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 65693 - RNA, 1701 nt, Artificial Sequence
  derived and/or modified sequence opt1 from hemagglutinin__InfluenzaA__ADG21018
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcagccagcaggccgugaucccgaacaucggcucccggcaccgcguccggaacauccccagccgcaucuccaucuacuggaccaucgugaagcccggcgacauccugcugaucaacagcaccgggaaccucaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucacguacggggccugcccgcgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 65694 - RNA, 1701 nt, Artificial Sequence
  derived and/or modified sequence opt1 from hemagglutinin__InfluenzaA__ADG21019
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacacgcugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaagaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgagcgggaagaucaucguguccacgaagcggagccagcagaccgugaucccgaacaucggcagccgcccccggguccgcaacauccccuccaucaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacagcgaggggcggggccaggccgccgaccugaaguccacccaggccgcgaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaucgggaacggcugcuucaagaucuaccacaagugcgacaacgccugcaucggguccauccggaacggcaccuacgaccacgacgucuaccgcgacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 65695 - RNA, 1701 nt, Artificial Sequence
  derived and/or modified sequence opt1 from hemagglutinin__InfluenzaA__ADG21020
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccaguccggcaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaucgugagcaccaagcgcagccagcagacggugaccccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 65696 - RNA, 1701 nt, Artificial Sequence; identical to SEQ ID NO: 63442
  derived and/or modified sequence opt1 from hemagglutinin__InfluenzaA__ADG21022

SEQ ID NO: 65697 - RNA, 1701 nt, Artificial Sequence; identical to SEQ ID NO: 63442
  derived and/or modified sequence opt1 from hemagglutinin__InfluenzaA__ADG21023

SEQ ID NO: 65698 - RNA, 1701 nt, Artificial Sequence
  derived and/or modified sequence opt1 from hemagglutinin__InfluenzaA__ADG21024
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcgcccuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucacguacggggcgugcccccgcuacgucaagcagagcacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccugaaguccacgcaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgcggaggacauggggaacggcugcuucaagaucuaccacaagugcgacaacgccugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 65699 - RNA, 1701 nt, Artificial Sequence
  derived and/or modified sequence opt1 from hemagglutinin__InfluenzaA__ADG21026
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggcugcgcguccggaacauccccucccgcaucagcaucuacuggaccaucgugaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgucaagcagagcacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcucaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacauggggaacggcugcuucaccaucuaccacaagugcgacaacgccugcaucgggagcauccgcaacggcaccuacgaccacaacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 65700 - RNA, 1701 nt, Artificial Sequence; identical to SEQ ID NO: 63677
  derived and/or modified sequence opt1 from hemagglutinin__InfluenzaA__ADG21037

SEQ ID NO: 65701 - RNA, 1701 nt, Artificial Sequence
  derived and/or modified sequence opt1 from hemagglutinin__InfluenzaA__ADG21038
augaaggccauccuggugguccuccuguacaccuucgccaccgcggacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65702 - RNA, 1701 nt, Artificial Sequence
  derived and/or modified sequence opt1 from hemagglutinin__InfluenzaA__ADG21040
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcguguaccagauccuggcgaucuacuccaccguggccagcagccugguccucguggugucccugggggccaucagcuucuggaugugcuccaacggcagccugcagugccggaucugcaucuga

SEQ ID NO: 65703 - RNA, 1701 nt, Artificial Sequence
  derived and/or modified sequence opt1 from hemagglutinin__InfluenzaA__ADG21041
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacagcaccgucgcgagcucccuggugcucguggucagccugggggccguguccuucuggaugugcagcaacggcucccugcagugccggaucugcaucuga

SEQ ID NO: 65704 - RNA, 1701 nt, Artificial Sequence; identical to SEQ ID NO: 64778
  derived and/or modified sequence opt1 from hemagglutinin__InfluenzaA__ADG21042

SEQ ID NO: 65705 - RNA, 1701 nt, Artificial Sequence
  derived and/or modified sequence opt1 from hemagglutinin__InfluenzaA__ADG21043
augaaggccauccuggugguccuccuguacaccuucaccacggccaacgcggacacccugugcgugggcuaccacgccaacaacagcaccgacaccguggacacgguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcacguccgcggaccagcagagccuguaccagaacgccgacgccuacguguucgucggcaccucccgguacagcaagaaguucaagcccgagaucgccauccgcccgaaggugcgggagcaggagggccgcaugaacuacuacuggacccugguggagcccggggacaagaucaccuucgaggccacgggcaaccucgucgugccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgucaaguccaccaagcugcggcucgccacgggccugcgcaacgugcccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggucaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgucaagcucgaguccacccgcaucuaccagauccuggccaucuacagcaccguggcgagcucccuggugcucgucgugagccugggggccaucuccuucuggaugugcagcaacggcucccugcagugccggaucugcaucuga

SEQ ID NO: 65706 - RNA, 1701 nt, Artificial Sequence
  derived and/or modified sequence opt1 from hemagglutinin__InfluenzaA__ADG21045
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65707 - RNA, 1701 nt, Artificial Sequence; identical to SEQ ID NO: 65706
  derived and/or modified sequence opt1 from hemagglutinin__InfluenzaA__ADG21046

SEQ ID NO: 65708 - RNA, 1701 nt, Artificial Sequence; identical to SEQ ID NO: 64841
  derived and/or modified sequence opt1 from hemagglutinin__InfluenzaA__ADG21048

SEQ ID NO: 65709 - RNA, 1701 nt, Artificial Sequence
  derived and/or modified sequence opt1 from hemagglutinin__InfluenzaA__ADG21049
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccuccaagggcgccaucaacaccagccugccguuccagaacauccaccccaucaccaucgggaagugccccaaguacgugaaguccaccaagcugcggcucgcgaccggccugcgcaacauccccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 65710 - RNA, 1701 nt, Artificial Sequence; identical to SEQ ID NO: 64030
  derived and/or modified sequence opt1 from hemagglutinin__InfluenzaA__ADG21122

SEQ ID NO: 65711 - RNA, 1701 nt, Artificial Sequence; identical to SEQ ID NO: 64841
  derived and/or modified sequence opt1 from hemagglutinin__InfluenzaA__ADG21123

SEQ ID NO: 65712 - RNA, 1701 nt, Artificial Sequence; identical to SEQ ID NO: 63677
  derived and/or modified sequence opt1 from hemagglutinin__InfluenzaA__ADG21124

SEQ ID NO: 65713 - RNA, 1701 nt, Artificial Sequence
  derived and/or modified sequence opt1 from hemagglutinin__InfluenzaA__ADG21125
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucaagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65714 - RNA, 1701 nt, Artificial Sequence; identical to SEQ ID NO: 63664
  derived and/or modified sequence opt1 from hemagglutinin__InfluenzaA__ADG21126

SEQ ID NO: 65715 - RNA, 1701 nt, Artificial Sequence; identical to SEQ ID NO: 63664
  derived and/or modified sequence opt1 from hemagglutinin__InfluenzaA__ADG21127

SEQ ID NO: 65716 - RNA, 1701 nt, Artificial Sequence; identical to SEQ ID NO: 63664
  derived and/or modified sequence opt1 from hemagglutinin__InfluenzaA__ADG21128

SEQ ID NO: 65717 - RNA, 1701 nt, Artificial Sequence; identical to SEQ ID NO: 63664
  derived and/or modified sequence opt1 from hemagglutinin__InfluenzaA__ADG21129

SEQ ID NO: 65718 - RNA, 1701 nt, Artificial Sequence; identical to SEQ ID NO: 63677
  derived and/or modified sequence opt1 from hemagglutinin__InfluenzaA__ADG21130

SEQ ID NO: 65719 - RNA, 1701 nt, Artificial Sequence; identical to SEQ ID NO: 63664
  derived and/or modified sequence opt1 from hemagglutinin__InfluenzaA__ADG21131

SEQ ID NO: 65720 - RNA, 1701 nt, Artificial Sequence; identical to SEQ ID NO: 63664
  derived and/or modified sequence opt1 from hemagglutinin__InfluenzaA__ADG21132

SEQ ID NO: 65721 - RNA, 1701 nt, Artificial Sequence; identical to SEQ ID NO: 63664
  derived and/or modified sequence opt1 from hemagglutinin__InfluenzaA__ADG21133

SEQ ID NO: 65722 - RNA, 1701 nt, Artificial Sequence; identical to SEQ ID NO: 63664
  derived and/or modified sequence opt1 from hemagglutinin__InfluenzaA__ADG21134

SEQ ID NO: 65723 - RNA, 1701 nt, Artificial Sequence; identical to SEQ ID NO: 63664
  derived and/or modified sequence opt1 from hemagglutinin__InfluenzaA__ADG21135

SEQ ID NO: 65724 - RNA, 1701 nt, Artificial Sequence; identical to SEQ ID NO: 63664
  derived and/or modified sequence opt1 from hemagglutinin__InfluenzaA__ADG21136

SEQ ID NO: 65725 - RNA, 1701 nt, Artificial Sequence; identical to SEQ ID NO: 63664
  derived and/or modified sequence opt1 from hemagglutinin__InfluenzaA__ADG21137

SEQ ID NO: 65726 - RNA, 1701 nt, Artificial Sequence; identical to SEQ ID NO: 63664
  derived and/or modified sequence opt1 from hemagglutinin__InfluenzaA__ADG21138

SEQ ID NO: 65727 - RNA, 1701 nt, Artificial Sequence; identical to SEQ ID NO: 63664
  derived and/or modified sequence opt1 from hemagglutinin__InfluenzaA__ADG21139

SEQ ID NO: 65728 - RNA, 1701 nt, Artificial Sequence
  derived and/or modified sequence opt1 from hemagglutinin__InfluenzaA__ADG21140
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugaugcucugggggauccaccaccccagcaccuccgccgaccagcagagccuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 65729 - RNA, 1701 nt, Artificial Sequence; identical to SEQ ID NO: 63664
  derived and/or modified sequence opt1 from hemagglutinin__InfluenzaA__ADG21141

SEQ ID NO: 65730 - RNA, 1701 nt, Artificial Sequence
  derived and/or modified sequence opt1 from hemagglutinin__InfluenzaA__ADG21142
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgagaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65731 - RNA, 1701 nt, Artificial Sequence; identical to SEQ ID NO: 63664
  derived and/or modified sequence opt1 from hemagglutinin__InfluenzaA__ADG21143

SEQ ID NO: 65732 - RNA, 1701 nt, Artificial Sequence; identical to SEQ ID NO: 63664
  derived and/or modified sequence opt1 from hemagglutinin__InfluenzaA__ADG21144

SEQ ID NO: 65733 - RNA, 1701 nt, Artificial Sequence
  derived and/or modified sequence opt1 from hemagglutinin__InfluenzaA__ADG21145
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaucagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65734 - RNA, 1701 nt, Artificial Sequence; identical to SEQ ID NO: 63664
  derived and/or modified sequence opt1 from hemagglutinin__InfluenzaA__ADG21146

SEQ ID NO: 65735 - RNA, 1701 nt, Artificial Sequence; identical to SEQ ID NO: 63664
  derived and/or modified sequence opt1 from hemagglutinin__InfluenzaA__ADG21147

SEQ ID NO: 65736 - RNA, 1701 nt, Artificial Sequence; identical to SEQ ID NO: 63677
  derived and/or modified sequence opt1 from hemagglutinin__InfluenzaA__ADG21148

SEQ ID NO: 65737 - RNA, 1701 nt, Artificial Sequence; identical to SEQ ID NO: 64778
  derived and/or modified sequence opt1 from hemagglutinin__InfluenzaA__ADG21149

SEQ ID NO: 65738 - RNA, 1701 nt, Artificial Sequence; identical to SEQ ID NO: 64841
  derived and/or modified sequence opt1 from hemagglutinin__InfluenzaA__ADG21150

SEQ ID NO: 65739 - RNA, 1701 nt, Artificial Sequence; identical to SEQ ID NO: 63664
  derived and/or modified sequence opt1 from hemagglutinin__InfluenzaA__ADG21151

SEQ ID NO: 65740 - RNA, 1701 nt, Artificial Sequence; identical to SEQ ID NO: 63664
  derived and/or modified sequence opt1 from hemagglutinin__InfluenzaA__ADG21152

SEQ ID NO: 65741 - RNA, 1701 nt, Artificial Sequence; identical to SEQ ID NO: 63677
  derived and/or modified sequence opt1 from hemagglutinin__InfluenzaA__ADG21153

SEQ ID NO: 65742 - RNA, 1701 nt, Artificial Sequence; identical to SEQ ID NO: 63664
  derived and/or modified sequence opt1 from hemagglutinin__InfluenzaA__ADG21154

SEQ ID NO: 65743 - RNA, 1701 nt, Artificial Sequence; identical to SEQ ID NO: 63664
  derived and/or modified sequence opt1 from hemagglutinin__InfluenzaA__ADG21155

SEQ ID NO: 65744 - RNA, 1701 nt, Artificial Sequence; identical to SEQ ID NO: 64841
  derived and/or modified sequence opt1 from hemagglutinin__InfluenzaA__ADG21156

SEQ ID NO: 65745 - RNA, 1701 nt, Artificial Sequence; identical to SEQ ID NO: 64849
  derived and/or modified sequence opt1 from hemagglutinin__InfluenzaA__ADG21158

SEQ ID NO: 65746 - RNA, 1701 nt, Artificial Sequence
  derived and/or modified sequence opt1 from hemagglutinin__InfluenzaA__ADG21159
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcuccuggugucccugggggccaucagcuucuggaugugcuccaacggcagccuccagugccggaucugcaucuga

SEQ ID NO: 65747 - RNA, 1701 nt, Artificial Sequence; identical to SEQ ID NO: 64849
  derived and/or modified sequence opt1 from hemagglutinin__InfluenzaA__ADG21160

SEQ ID NO: 65748 - RNA, 1701 nt, Artificial Sequence
  derived and/or modified sequence opt1 from hemagglutinin__InfluenzaA__ADG21161
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacaacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 65749 - RNA, 1701 nt, Artificial Sequence
  derived and/or modified sequence opt1 from hemagglutinin__InfluenzaA__ADG21163
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacguguggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65750 - RNA, 1701 nt, Artificial Sequence
  derived and/or modified sequence opt1 from hemagglutinin__InfluenzaA__ADG21165
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgcgagcuccuggagcuacaucgucgagaccuccagcuccgacaacggcacgugcuaccccggcgacuucaucgacuacgaggagcuccgggagcagcugagcuccgugagcuccuucaagcgcuucgagaucuuccccaagaccaacagcuggcccaaccacgacuccaacaagggggugaccgccgccugcccgcacgccggcgccaagagcuucuacaagaaccugaucuggcucgucaagaaggggaacuccuaccccaagcugagcaaguccuacaucaacgacaagggcaaggaggugcuggugcucugggggauccaccaccccagcaccagcgccgaccagcagucccuguaccagaacgccgacgccuacgucuucgugggcacgagcaaguacuccaagaaguucaagcccgagaucgccauccggccgaaggugcgcgaccaggagggccggaugaacuacuacuggacccuggucgagcccggggacaagaucaccuucgaggcgaccggcaaccucguggugccccgcuacgccuucgccauggagcggaacgccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgugccgagcauccagucccgcgggcuguucggcgccaucgccggguucaucgagggcggcuggacggggauggucgacggcugguacggguaccaccaccagaacgagcagggcagcggguacgccgccgaccucaaguccacccagaacgcgaucgacggcaucaccaacaaggugaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacagcaccguggccuccagccugguccucguggugagccugggcgccaucuccuucuggaugugcagcaacggcucccugcagugccgcaucugcaucuga

SEQ ID NO: 65751 - RNA, 1701 nt, Artificial Sequence; identical to SEQ ID NO: 63664
  derived and/or modified sequence opt1 from hemagglutinin__InfluenzaA__ADG21166

SEQ ID NO: 65752 - RNA, 1701 nt, Artificial Sequence
  derived and/or modified sequence opt1 from hemagglutinin__InfluenzaA__ADG21168
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaaguucuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65753 - RNA, 1701 nt, Artificial Sequence; identical to SEQ ID NO: 65706
  derived and/or modified sequence opt1 from hemagglutinin__InfluenzaA__ADG21169

SEQ ID NO: 65754 - RNA, 1701 nt, Artificial Sequence; identical to SEQ ID NO: 63664
  derived and/or modified sequence opt1 from hemagglutinin__InfluenzaA__ADG21170

SEQ ID NO: 65755 - RNA, 1701 nt, Artificial Sequence; identical to SEQ ID NO: 63664
  derived and/or modified sequence opt1 from hemagglutinin__InfluenzaA__ADG21173

SEQ ID NO: 65756 - RNA, 1701 nt, Artificial Sequence; identical to SEQ ID NO: 63677
  derived and/or modified sequence opt1 from hemagglutinin__InfluenzaA__ADG21174

SEQ ID NO: 65757 - RNA, 1701 nt, Artificial Sequence; identical to SEQ ID NO: 63677
  derived and/or modified sequence opt1 from hemagglutinin__InfluenzaA__ADG21175

SEQ ID NO: 65758 - RNA, 1701 nt, Artificial Sequence; identical to SEQ ID NO: 63664
  derived and/or modified sequence opt1 from hemagglutinin__InfluenzaA__ADG21176

SEQ ID NO: 65759 - RNA, 1701 nt, Artificial Sequence; identical to SEQ ID NO: 63664
  derived and/or modified sequence opt1 from hemagglutinin__InfluenzaA__ADG21177

SEQ ID NO: 65760 - RNA, 1701 nt, Artificial Sequence; identical to SEQ ID NO: 63664
  derived and/or modified sequence opt1 from hemagglutinin__InfluenzaA__ADG21178

SEQ ID NO: 65761 - RNA, 1701 nt, Artificial Sequence; identical to SEQ ID NO: 64030
  derived and/or modified sequence opt1 from hemagglutinin__InfluenzaA__ADG21179

SEQ ID NO: 65762 - RNA, 1701 nt, Artificial Sequence; identical to SEQ ID NO: 63664
  derived and/or modified sequence opt1 from hemagglutinin__InfluenzaA__ADG21180

SEQ ID NO: 65763 - RNA, 1701 nt, Artificial Sequence; identical to SEQ ID NO: 63664
  derived and/or modified sequence opt1 from hemagglutinin__InfluenzaA__ADG21181

SEQ ID NO: 65764 - RNA, 1701 nt, Artificial Sequence; identical to SEQ ID NO: 63664
  derived and/or modified sequence opt1 from hemagglutinin__InfluenzaA__ADG21182

SEQ ID NO: 65765 - RNA, 1701 nt, Artificial Sequence; identical to SEQ ID NO: 63664
  derived and/or modified sequence opt1 from hemagglutinin__InfluenzaA__ADG21183

SEQ ID NO: 65766 - RNA, 1701 nt, Artificial Sequence; identical to SEQ ID NO: 64841
  derived and/or modified sequence opt1 from hemagglutinin__InfluenzaA__ADG21184

SEQ ID NO: 65767 - RNA, 1701 nt, Artificial Sequence
  derived and/or modified sequence opt1 from hemagglutinin__InfluenzaA__ADG21185
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggcggugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 65768 - RNA, 1701 nt, Artificial Sequence; identical to SEQ ID NO: 65023
  derived and/or modified sequence opt1 from hemagglutinin__InfluenzaA__ADG21188

SEQ ID NO: 65769 - RNA, 1707 nt, Artificial Sequence
  derived and/or modified sequence opt1 from hemagglutinin__InfluenzaA__ADG21402
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggagcaaggucaacgggcaguccggccgcauggaguucuucuggaccauccucaagagcaacgacgcgaucaacuucgagagcaacgggaacuucaucgcccccgagaacgccuacaagaucgugaagaagggcgacuccacgaucaugaaguccgagcuggaguacggcaacugcaacaccaagugccagacccccaucggggccaucaacagcagcaugccguuccacaacauccacccccugaccaucggcgagugccccaaguacgugaaguccaaccggcugauccuggccacggggcuccgcaacagcccccagggcgagcggcgccggaagaagcgcggccuguucggggcgaucgccggcuucaucgagggcggguggcaggggauggucgacggcugguacggcuaccaccacuccaacgagcaggggagcggcuacgccgccgacaaggaguccacccagaaggccaucgacggggugaccaacaaggugaacagcaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccgcaguacuccgaggaggcccgccugaagcgggaggagaucagcggcgugaagcuggaguccaucgggaccuaccagauccucagcaucuacuccacgguggccagcucccuggcgcuggccaucauggucgccggccucuuccuguggaugugcagcaacgggagccugcagugccgcaucugcaucuga

SEQ ID NO: 65770 - RNA, 1704 nt, Artificial Sequence
  derived and/or modified sequence opt1 from hemagglutinin__InfluenzaA__ADG21414
auggagaagaucgugcugcuccuggccaucgucagcaucgugaaguccgaccagaucugcaucggcuaccacgccaacaacagcaccgagcacguggacaccaucauggagaagaacgucacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacggcgccgagcagacccgccucuaccagaacccgaccacguacaucagcguggggaccuccacccugaaccagcggcuggugcccaagaucgccacccgcagcaaggucaacggccaguccgggcggauggaguucuucuggacgauccucaagagcaacgacgccaucaacuucgaguccaacggcaacuucaucgcgcccgagaacgccuacaagaucgugaagaagggcgacagcaccaucaugaaguccgagcuggaguacgggaacugcaacaccaagugccagacccccaucggcgccaucaacagcagcaugccguuccacaacauccacccccugacgaucggggagugccccaaguacgugaaguccaaccgccucguccuggccaccggccugcggaacagcccccagggcgagcgccggcgcaagaagcggggccucuucggggccaucgcgggguucaucgagggcggguggcagggcaugguggacggcugguacggguaccaccacuccaacgagcagggcagcggguacgccgccgacaaggaguccacccagaaggccaucgacggcgugaccaacaaggucaacagcaucaucgacaagaugaacacgcaguucgaggccguggggcgcgaguucaacaaccuggagcggcgcaucgagaaccugaacaagaagauggaggacggcuuccucgacguguggaccuacaacgcggagcugcugguccucauggagaacgagcggacccuggacuuccacgacuccaacgugaagaaccuguacgacaagguccgccuccagcugcgggacaacgccaaggagcugggcaacgggugcuucgaguucuaccaccgcugcgacaacgagugcauggagagcgugcggaacggcaccuacgacuacccgcaguacuccgaggaggcccgccucaagcgcgaggagaucagcggggugaagcuggaguccaucggcacguaccagauccugagcaucuacuccaccgucgccagcucccucgcccuggcgaucaugguggccgggcuguuccucuggaugugcagcaacggcucccugcagugccggaucugcaucuga

SEQ ID NO: 65771 - RNA, 1704 nt, Artificial Sequence
  derived and/or modified sequence opt1 from hemagglutinin__InfluenzaA__ADG21416
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacgccgccgagcagaccggccucuaccagaacccgaccacguacaucagcguggggaccuccacccugaaccagcgccuggugcccaagaucgccacccggagcaaggucaacggccaguccgggcgcauggaguucuucuggacgauccucaagagcaacgacgugaucaacuucgaguccaacggcaacuucaucgcgcccgagaacgccuacaagaucgugaagaagggcgacagcaccaucaugaaguccgagcuggaguacgggaacugcaacaccaagugccagacccccaucggcgccaucaacagcagcaugccguuccacaacauccacccccugacgaucggggagugccccaaguacgucaaguccaaccggcucgugcuggccaccggccugcgcaacagcccccagggcgagcggcgccggaagaagcgcggccucuucggggccaucgcgggguucaucgagggcggguggcagggcaugguggacggcugguacggguaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcugggcaacgggugcuucgaguucuaccaccggugcgacaacgagugcauggagagcgugcgcaacggcaccuacgacuacccgcaguacuccgaggaggcccggcucaagcgcgaggagaucagcggggucaagcuggaguccaucggcacguaccagauccugagcaucuacuccaccguggccagcucccucgcccuggcgaucaugguggccgggcuguuccucuggaugugcagcaacggcucccugcagugccgcaucugcaucuga

SEQ ID NO: 65772 - RNA, 1704 nt, Artificial Sequence
  derived and/or modified sequence opt1 from hemagglutinin__InfluenzaA__ADG21420
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcagcaaggucaacgggcaguccggccggauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccgccucguccuggccaccgggcugcggaacagcccccagggcgagcgccggcgcaagaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgcgaguucaacaaccuggagcggcgcaucgagaaccugaacaagaagauggaggacggguuccucgacguguggaccuacaacgccgagcugcugguccucauggagaacgagcggacccuggacuuccacgacuccaacgugaagaaccuguacgacaagguccgccuccagcugcgggacaacgccaaggagcugggcaacggcugcuucgaguucuaccaccgcugcgacaacgagugcauggagagcgugcggaacgggaccuacgacuacccgcaguacuccgaggaggcccgccucaagcgcgaggagaucagcggcgugaagcuggaguccaucgggacguaccagauccugagcaucuacuccaccgucgccagcucccucgcgcuggccaucaugguggccggccuguuccucuggaugugcagcaacgggucccugcagugccggaucugcaucuga

SEQ ID NO: 65773 - RNA, 1704 nt, Artificial Sequence
  derived and/or modified sequence opt1 from hemagglutinin__InfluenzaA__ADG21422
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccaccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugacgaagaagaacaacgccuaccccaccaucaagcgcuccuacaacaacaccaaccaggaggaccugcugguccucugggggauccaccaccccaacgacgcggccgagcagacccggcuguaccagaacccgacgaccuacaucagcgugggcaccuccacccugaaccagcgccucgugcccaagaucgccacgcggagcaaggucaacgggcaguccggccgcauggaguucuucuggaccauccucaagagcaacgacgccaucaacuucgaguccaacgggaacuucaucgcgcccgagaacgccuacaagaucgugaagaagggcgacagcaccaucaugaaguccgagcuggaguacggcaacugcaacaccaagugccagacgcccaucggggccaucaacagcagcaugccguuccacaacauccacccccugaccaucggcgagugccccaaguacgugaaguccaaccggcugguccuggccaccgggcuccgcaacagcccccagggcgagcggcgccggaagaagcgcggccuguucggggccaucgcgggcuucaucgagggcggguggcaggggaugguggacggcugguacggcuaccaccacuccaacgagcaggggagcggcuacgccgccgacaaggaguccacccagaaggccaucgacggggugacgaacaaggucaacagcaucaucgacaagaugaacacccaguucgaggccgugggccgggaguucaacaaccuggagcgccggaucgagaaccucaacaagaagauggaggacggguuccuggacguguggaccuacaacgcggagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggacguacgacuacccgcaguacuccgaggaggcccgcagcaagcgggaggagaucuccggcgugaagcuggagagcaucgggaccuaccagauccuguccaucuacagcaccgucgccuccagccucgcccuggcgaucaugguggccggccuguuccucuggaugugcuccaacgggagccugcagugccgcaucugcaucuga

SEQ ID NO: 65774 - RNA, 1704 nt, Artificial Sequence
  derived and/or modified sequence opt1 from hemagglutinin__InfluenzaA__ADG21425
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacggcgccagcggcgucuccagcgccugccccuaccaggggcgcuccagcuucuuccggaacgugguguggcugaccaagaagaacaacgcguaccccacgaucaagaaguccuacaacaacaccaaccaggaggaccugcugguccucuggggcauccaccaccccaacgacgccgaggagcagacccgccuguaccagaacccgaccacguacaucagcguggggaccuccacccugaaccagcggcucgugcccaagaucgccacccgcagcaaggucaacggccaguccgggcggauggaguucuucuggacgauccucaagagcaacgacgccaucaacuucgaguccaacggcaacuucaucgcgcccgagaacgccuacaagaucgugaagaagggcgacagcaccaucaugaaguccgagcuggaguacgacaacugcaacaccaagugccagacccccaucggggccaucaacagcagcaugccguuccacaacauccacccccugacgaucggcgagugccccaaguacgugaaguccaacaagcugguccuggccaccgggcuccgcaacagcccccagggcgagaagcggcgcaagaagcggggccuguucggggccaucgcgggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggccgugggccgcgaguucaacgcgcuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccaccgcugcgacaacgagugcauggagagcgugcggaacgggaccuacgacuacccgcaguacuccgaggaggcccgccugaagcgggaggagaucagcggcgugaagcuggaguccaucgggacguaccagauccucagcaucuacuccaccgucgccagcucccuggcgcuggccaucaugguggccggccucagccuguggaugugcuccaacgggagccugcagugccgcaucugcaucuga

SEQ ID NO: 65775 - RNA, 1704 nt, Artificial Sequence
  derived and/or modified sequence opt1 from hemagglutinin__InfluenzaA__ADG21429
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcguggagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcagcaaggucaacgggcaguccggccggauggaguucuucuggacgauccucaagagcaacgacgugaucaacuucgaguccaacgggaacuucaucgcgcccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgucaaguccgaccgccucgugcuggccaccgggcugcggaacagcccccagggcgagcgccggcgcaagaagcggggccucuucggggccaucgcgggcuucaucgagggcggguggcaggggaugguggacggcugguacggcuaccaccacuccaacgagcaggggagcggcuacgccgccgacaaggaguccacccagaaggccaucgacggggucaccaacaaggugaacagcaucaucgacaagaugaacacgcaguucgaggccgugggccgcgaguucaacaaccuggagcggcgcaucgagaaccugaacaagaagauggaggacggguuccucgacgucuggaccuacaacgcggagcugcuggugcucauggagaacgagcggacccuggacuuccacgacuccaacgucaagaaccuguacgacaaggugcgccuccagcugcgggacaacgccaaggagcugggcaacggcugcuucgaguucuaccaccgcugcgacaacgagugcauggagagcgugcggaacgggaccuacgacuacccgcaguacuccgaggaggcccgccucaagcgcgaggagaucagcggcgucaagcuggaguccaucgggacguaccagauccugagcaucuacuccaccguggccagcucccucgcccuggcgaucaugguggccggccugcuccuguggaugugcagcaacgggucccugcagugccggaucugcaucuga

SEQ ID NO: 65776 - RNA, 1704 nt, Artificial Sequence
  derived and/or modified sequence opt1 from hemagglutinin__InfluenzaA__ADG21437
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugacccagaagaacaacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcagcaaggucaacgggcaguccggccggauggaguucuucuggacgauccucaagagcaacgacgugaucaacuucgaguccaacgggaacuucaucgcgcccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgucaaguccaaccgccucgugcuggccaccgggcugcggaacagcccccagggcgagcgccggcgcaagaagcggggccucuucggggccaucgcgggcuucaucgagggcggguggcaggggaugguggacggcugguacggcuaccaccacuccaacgagcaggggagcggcuacgccgccgacaaggaguccacccagaaggccaucgacggggucaccaacaaggugaacagcaucaucgacaagaugaacacgcaguucgaggccgugggccgcgaguucaacaaccuggagcggcgcaucgagaaccugaacaagaagauggaggacggguuccucgacgucuggaccuacaacgcggagcugcuggugcucauggagaacgagcggacccuggacuuccacgacuccaacgucaagaaccuguacgacaaggugcgccuccagcugcgggacaacgccaaggagcugggcaacggcugcuucgaguucuaccaccgcugcgacaacgagugcauggagagcgugcggaacgggaccuacgacuacccgcaguacuccgaggaggcccgccucaagcgcgaggagaucagcggcgucaagcuggaguccaucgggacguaccagauccugagcaucuacuccaccguggccagcucccucgcccuggcgaucaugguggccggccuguuccucuggaugugcagcaacgggucccugcagugccggaucugcaucuga

SEQ ID NO: 65777 - RNA, 1704 nt, Artificial Sequence
  derived and/or modified sequence opt1 from hemagglutinin__InfluenzaA__ADG21439
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagggcagcugguccgaccacgaggccagcggcgucuccagcgccugccccuaccaggggcgcuccagcuucuuccggaacgugguguggcugaccaagaagaacaacgcguaccccacgaucaagaaguccuacaacaacaccaaccaggaggaccuccugguccuguggggcauccaccaccccaacgacgccgccgagcagacccgccucuaccagaacccgaccacguacaucagcguggggaccuccacccugaaccagcggcuggugccccagaucgccacccgcagcaaggucaacggccaguccgggcggauggaguucuucuggacgauccucaagagcaacgacgcgaucaacuucgaguccaacggcaacuucaucgcccccgagaacgccuacaagaucgugaagaagggcgacagcaccaucaugaaguccgagcuggaguacgggaacugcaacaccaagugccagacccccaucggcgccaucaacagcagcaugccguuccacaacauccacccccugacgaucggggagugccccaaguacgugaaguccaaccgccucguccuggccaccggccugcggaacagcccccagggcgagcgccggcgcaagaagcggggccucuucggggcgaucgccggguucaucgagggcggguggcagggcaugguggacggcugguacggguaccaccacuccaacgagcagggcagcggguacgccgccgacaaggaguccacccagaaggccaucgacggcgugaccaacaaggucaacagcaucaucgacaagaugaacacgcaguucgaggcgguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacuccaacgugaagaaccuguacgacaagguccgccuccagcugcgggacaacgccaaggagcugggcaacgggugcuucgaguucuaccaccgcugcgacaacgagugcauggagagcgugcggaacggcaccuacgacuacccgcaguacuccgaggaggcccgccucaagcgcgaggagaucagcggggugaagcuggaguccaucggcacguaccagauccugagcaucuacuccaccgucgccagcucccucgcgcuggccaucaugguggccgggcuguuccucuggaugugcagcaacggcucccugcagugccggaucugcaucuga

SEQ ID NO: 65778 - RNA, 1704 nt, Artificial Sequence
  derived and/or modified sequence opt1 from hemagglutinin__InfluenzaA__ADG21441
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccuccaacgaccugugcuaccccgggaacuucaacgacuacgaggagcugaagcaccuccugagccggaucaaccacuucgagaagauccagaucaucccgaagaacuccuggagcgaccacgaggccuccggcgucagcuccgccugccccuaccagggccgcagcuccuucuuccggaacgugguguggcugaccaagaagaacaacgccuaccccacgaucaagaaguccuacaacaacaccaaccaggaggaccuccugguccugugggggauccaccaccccaacgacgaggcggagcagaccagccucuaccagaacccgaccacguacaucagcgugggcaccuccacccugaaccagcgccuggugcccaagaucgccacccggagcaaggucaacgggcaguccggccgcauggaguucuucuggacgauccucaagagcaacgacgccaucaacuucgagagcaacgggaacuucaucgcccccgagaacgcguacaagaucgugaagaagggcgacuccaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcucguccuggccaccgggcugcgcaacagcccccagggcgagcggcgccggaagaagcgcggccucuucggggccaucgccggcuucaucgagggcggguggcaggggaugguggacggcugguacggcuaccaccacuccaacgagcaggggagcggcuacgcggccgacaaggaguccacccagaaggccaucgacggggugaccaacaaggucaacagcaucaucgacaagaugaacacgcaguucgaggccgugggccgggaguucaacaaccuggagcgccggaucgagaaccugaacaagaagauggaggacggguuccucgacguguggaccuacaacgccgagcugcugguccucauggagaacgagcgcacccuggacuuccacgacuccaacgugaagaaccuguacgacaagguccggcuccagcugcgcgacaacgcgaaggagcugggcaacggcugcuucgaguucuaccaccggugcgacaacgagugcauggagagcgugcgcaacgggaccuacgacuacccgcaguacuccgaggaggcccggcucaagcgcgaggagaucagcggcgugaagcuggaguccaucgggacguaccagauccugagcaucuacuccaccgucgccagcucccucgcccuggccaucaugguggcgggccuguuccucuggaugugcagcaacgggagccugcagugccgcaucugcaucuga

SEQ ID NO: 65779 - RNA, 1704 nt, Artificial Sequence
  derived and/or modified sequence opt1 from hemagglutinin__InfluenzaA__ADG21443
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccaccaacgaccugugcuaccccgggaacuucaacgacuacgaggagcugaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugacgaagaagaacaacgccuaccccaccaucaagaaguccuacaacaacaccaaccaggaggaccuccugguccugugggggauccaccaccccaacgacgcggccgagcagacccgccucuaccagaacccgacgaccuacaucagcgugggcaccuccacccugaaccagcggcuggugcccaagaucgccacgcgcagcaaggucaacgggcaguccggccggauggaguucuucuggaccauccucaagagcaacgacgccaucaacuucgaguccaacgggaacuucaucgcgcccgagaacgccuacaagaucgugaagaagggcgacagcaccaucaugaaguccgagcuggaguacggcaacugcaacaccaagugccagacgcccaucggggccaucaacagcagcaugccguuccacaacauccacccccugaccaucggcgagugccccaaguacgugaaguccaaccgccucguccuggccaccgggcugcggaacagcccccagggcgagcgccggcgcaagaagcggggccucuucggggccaucgcgggcuucaucgagggcggguggcaggggaugguggacggcugguacggcuaccaccacuccaacgagcaggggagcggcuacgccgccgacaaggaguccacccagaaggccaucgacggggugacgaacaaggucaacagcaucaucgacaagaugaacacccaguucgaggccgugggccgcgaguucaacaaccuggagcggcgcaucgagaaccugaacaagaagauggaggacggguuccucgacguguggaccuacaacgcggagcugcugguccucauggagaacgagcggacccuggacuuccacgacuccaacgugaagaaccuguacgacaagguccgccuccagcugcgggacaacgccaaggagcugggcaacggcugcuucgaguucuaccaccgcugcgacaacgagugcauggagagcgugcggaacgggacguacgacuacccgcaguacuccgaggaggcccgccucaagcgcgaggagaucagcggcgugaagcuggaguccaucgggaccuaccagauccugagcaucuacuccaccgucgccagcucccucgcccuggcgaucaugguggccggccuguuccucuggaugugcagcaacgggucccugcagugccggaucugcaucuga

SEQ ID NO: 65780 - RNA, 1704 nt, Artificial Sequence
  derived and/or modified sequence opt1 from hemagglutinin__InfluenzaA__ADG21445
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccuccaacgaccugugcuaccccgggaacuucaacgacuacgaggagcugaagcaccuccugagccggaucaaccacuucgagaagauccagaucaucccgaagaacuccuggagcgaccacgaggccuccggcgucagcuccgccugccccuaccagggccgcagcuccuucuuccggaacgugguguggcugaccaagaagaacaacgccuaccccacgaucaagaaguccuacaacaacaccaaccaggaggaccuccugguccugugggggauccaccaccccaacgacgaggcggagcagacccgccucuaccagaacccgaccacguacaucuccgugggcaccagcacccugaaccagcggcuggugcccaagaucgccacccgcuccaaggucaacgggcagagcggccggauggaguucuucuggacgauccucaaguccaacgacgccaucaacuucgagagcaacgggaacuucaucgcccccgagaacgcguacaagaucgugaagaagggcgacagcaccaucaugaaguccgagcuggaguacggcaacugcaacaccaagugccagacccccaucggggccaucaacagcuccaugccguuccacaacauccacccccugacgaucggcgagugccccaaguacgucaagagcaaccgccucgugcuggccaccgggcugcggaacagcccccagggcgagcgccggcgcaagaagcggggccucuucggggccaucgccggcuucaucgagggcggguggcaggggaugguggacggcugguacggcuaccaccacagcaacgagcagggguccggcuacgcggccgacaaggagagcacccagaaggccaucgacggggugaccaacaaggucaacuccaucaucgacaagaugaacacgcaguucgaggccgugggccgcgaguucaacaaccuggagcggcgcaucgagaaccugaacaagaagauggaggacggguuccucgacguguggaccuacaacgccgagcugcugguccucauggagaacgagcggacccuggacuuccacgacagcaacgugaagaaccuguacgacaagguccgccuccagcugcgggacaacgcgaaggagcugggcaacggcugcuucgaguucuaccaccgcugcgacaacgagugcauggaguccgugcggaacgggaccuacgacuacccgcaguacagcgaggaggcccgccucaagcgcgaggagaucuccggcgugaagcuggagagcaucgggacguaccagauccuguccaucuacagcaccgucgccuccagccucgcccuggccaucaugguggcgggccuguuccucuggaugugcuccaacgggagccugcagugccggaucugcaucuga

SEQ ID NO: 65781 - RNA, 1701 nt, Artificial Sequence; identical to SEQ ID NO: 63919
  derived and/or modified sequence opt1 from hemagglutinin__InfluenzaA__ADG21912

SEQ ID NO: 65782 - RNA, 1701 nt, Artificial Sequence; identical to SEQ ID NO: 63677
  derived and/or modified sequence opt1 from hemagglutinin__InfluenzaA__ADG21913

SEQ ID NO: 65783 - RNA, 1701 nt, Artificial Sequence
  derived and/or modified sequence opt1 from hemagglutinin__InfluenzaA__ADG21914
augaaggccaucaucgugguccugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65784 - RNA, 1701 nt, Artificial Sequence
  derived and/or modified sequence opt1 from hemagglutinin__InfluenzaA__ADG21915
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccaucgagcgcaacgccgggagcggcaucaucaucuccgacacccccgugcacgacugcaacacgaccugccagaccccgaagggcgccaucaacaccagccuccccuuccacaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 65785 - RNA, 1701 nt, Artificial Sequence; identical to SEQ ID NO: 63919
  derived and/or modified sequence opt1 from hemagglutinin__InfluenzaA__ADG21916

SEQ ID NO: 65786 - RNA, 1701 nt, Artificial Sequence; identical to SEQ ID NO: 63677
  derived and/or modified sequence opt1 from hemagglutinin__InfluenzaA__ADG21917

SEQ ID NO: 65787 - RNA, 1701 nt, Artificial Sequence; identical to SEQ ID NO: 65177
  derived and/or modified sequence opt1 from hemagglutinin__InfluenzaA__ADG21918

SEQ ID NO: 65788 - RNA, 1701 nt, Artificial Sequence
  derived and/or modified sequence opt1 from hemagglutinin__InfluenzaA__ADG21919
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgcggccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 65789 - RNA, 1701 nt, Artificial Sequence; identical to SEQ ID NO: 63919
  derived and/or modified sequence opt1 from hemagglutinin__InfluenzaA__ADG21921

SEQ ID NO: 65790 - RNA, 1701 nt, Artificial Sequence; identical to SEQ ID NO: 63677
  derived and/or modified sequence opt1 from hemagglutinin__InfluenzaA__ADG21922

SEQ ID NO: 65791 - RNA, 1701 nt, Artificial Sequence
  derived and/or modified sequence opt1 from hemagglutinin__InfluenzaA__ADG21923
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcuccagcaaguacuccaagaaguucaagcccgagaucgcgauccggccgaaggugcgcgaccaggagggccggaugaacuacuacuggacgcuggucgagcccggggacaagaucaccuucgaggccaccggcaaccucguggugccccgcuacgccuucgccauggagcggaacgccgggagcggcaucaucaucuccgacacccccguccacgacugcaacacgaccugccagaccccgaagggcgcgaucaacaccagccugcccuuccacaacauccaccccaucacgaucgggaagugccccaaguacgugaaguccaccaagcugcgccucgccaccggccugcggaacgugccgagcauccagucccgcgggcuguucggcgccaucgccggguucaucgagggcggcuggaccgggauggucgacggcugguacggguaccaccaccagaacgagcagggcagcggguacgccgcggaccucaaguccacgcagaacgccaucgacgagaucaccaacaaggugaacagcgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacuccaacgugaagaaccucuacgagaaggugcggagccagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgcgaggagaucgacggcgugaagcucgaguccacccggaucuaccagauccuggccaucuacagcaccguggccagcucccugguccucguggugagccugggggccaucuccuucuggaugugcagcaacggcucccugcagugccgcaucugcaucuga

SEQ ID NO: 65792 - RNA, 1701 nt, Artificial Sequence
  derived and/or modified sequence opt1 from hemagglutinin__InfluenzaA__ADG21924
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65793 - RNA, 1701 nt, Artificial Sequence
  derived and/or modified sequence opt1 from hemagglutinin__InfluenzaA__ADG21925
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65794 - RNA, 1701 nt, Artificial Sequence
  derived and/or modified sequence opt1 from hemagglutinin__InfluenzaA__ADG21926
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggaaccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65795 - RNA, 1701 nt, Artificial Sequence; identical to SEQ ID NO: 63919
  derived and/or modified sequence opt1 from hemagglutinin__InfluenzaA__ADG21927

SEQ ID NO: 65796 - RNA, 1701 nt, Artificial Sequence
  derived and/or modified sequence opt1 from hemagglutinin__InfluenzaA__ADG21928
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgcggguccgcgaccaggagggccggaugaacuacuacuggacccugguggagcccggggacaagaucaccuucgaggcgacgggcaaccucguggucccccgcuacgccuucgccauggagcgggacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 65797 - RNA, 1701 nt, Artificial Sequence; identical to SEQ ID NO: 65793
  derived and/or modified sequence opt1 from hemagglutinin__InfluenzaA__ADG21930

SEQ ID NO: 65798 - RNA, 1701 nt, Artificial Sequence; identical to SEQ ID NO: 63919
  derived and/or modified sequence opt1 from hemagglutinin__InfluenzaA__ADG21931

SEQ ID NO: 65799 - RNA, 1701 nt, Artificial Sequence; identical to SEQ ID NO: 63919
  derived and/or modified sequence opt1 from hemagglutinin__InfluenzaA__ADG21932

SEQ ID NO: 65800 - RNA, 1701 nt, Artificial Sequence; identical to SEQ ID NO: 63919
  derived and/or modified sequence opt1 from hemagglutinin__InfluenzaA__ADG21933

SEQ ID NO: 65801 - RNA, 1701 nt, Artificial Sequence; identical to SEQ ID NO: 65793
  derived and/or modified sequence opt1 from hemagglutinin__InfluenzaA__ADG21934

SEQ ID NO: 65802 - RNA, 1701 nt, Artificial Sequence
  derived and/or modified sequence opt1 from hemagglutinin__InfluenzaA__ADG21935
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaacugccagaccccgaacggcgccaucaacaccagccugcccuuccacaacauccaccccaucaccaucgggaagugccccaaguacgugaaguccacgaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucacgaacaaggugaacagcgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65803 - RNA, 1701 nt, Artificial Sequence; identical to SEQ ID NO: 63919
  derived and/or modified sequence opt1 from hemagglutinin__InfluenzaA__ADG21936

SEQ ID NO: 65804 - RNA, 1701 nt, Artificial Sequence; identical to SEQ ID NO: 63919
  derived and/or modified sequence opt1 from hemagglutinin__InfluenzaA__ADG21937

SEQ ID NO: 65805 - RNA, 1701 nt, Artificial Sequence
  derived and/or modified sequence opt1 from hemagglutinin__InfluenzaA__ADG21938
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggaaccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65806 - RNA, 1701 nt, Artificial Sequence; identical to SEQ ID NO: 63919
  derived and/or modified sequence opt1 from hemagglutinin__InfluenzaA__ADG21939

SEQ ID NO: 65807 - RNA, 1701 nt, Artificial Sequence; identical to SEQ ID NO: 63919
  derived and/or modified sequence opt1 from hemagglutinin__InfluenzaA__ADG21940

SEQ ID NO: 65808 - RNA, 1701 nt, Artificial Sequence
  derived and/or modified sequence opt1 from hemagglutinin__InfluenzaA__ADG21941
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaagaucgacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 65809 - RNA, 1701 nt, Artificial Sequence
  derived and/or modified sequence opt1 from hemagglutinin__InfluenzaA__ADG21943
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 65810 - RNA, 1701 nt, Artificial Sequence
  derived and/or modified sequence opt1 from hemagglutinin__InfluenzaA__ADG21944
auggaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 65811 - RNA, 1701 nt, Artificial Sequence; identical to SEQ ID NO: 63919
  derived and/or modified sequence opt1 from hemagglutinin__InfluenzaA__ADG21945

SEQ ID NO: 65812 - RNA, 1701 nt, Artificial Sequence; identical to SEQ ID NO: 63919
  derived and/or modified sequence opt1 from hemagglutinin__InfluenzaA__ADG21946

SEQ ID NO: 65813 - RNA, 1701 nt, Artificial Sequence; identical to SEQ ID NO: 63919
  derived and/or modified sequence opt1 from hemagglutinin__InfluenzaA__ADG21947

SEQ ID NO: 65814 - RNA, 1701 nt, Artificial Sequence
  derived and/or modified sequence opt1 from hemagglutinin__InfluenzaA__ADG21948
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggaccaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65815 - RNA, 1701 nt, Artificial Sequence
  derived and/or modified sequence opt1 from hemagglutinin__InfluenzaA__ADG27794
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaccuaccagauccuggcgaucuacuccaccgucgccagcagccuggugcucguggucucccugggggccaucagcuucuggaugugcuccaacggcagccugcagugccggaucugcaucuga

SEQ ID NO: 65816 - RNA, 1701 nt, Artificial Sequence; identical to SEQ ID NO: 63664
  derived and/or modified sequence opt1 from hemagglutinin__InfluenzaA__ADG27948

SEQ ID NO: 65817 - RNA, 1701 nt, Artificial Sequence; identical to SEQ ID NO: 63664
  derived and/or modified sequence opt1 from hemagglutinin__InfluenzaA__ADG27966

SEQ ID NO: 65818 - RNA, 1701 nt, Artificial Sequence
  derived and/or modified sequence opt1 from hemagglutinin__InfluenzaA__ADG27974
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccugauccucguggugagccugggggccaucuccuucuggaugugcagcaacggcucccugcagugccggaucugcaucuga

SEQ ID NO: 65819 - RNA, 1701 nt, Artificial Sequence
  derived and/or modified sequence opt1 from hemagglutinin__InfluenzaA__ADG27982
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaagcucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65820 - RNA, 1701 nt, Artificial Sequence; identical to SEQ ID NO: 63664
  derived and/or modified sequence opt1 from hemagglutinin__InfluenzaA__ADG27988

SEQ ID NO: 65821 - RNA, 1701 nt, Artificial Sequence; identical to SEQ ID NO: 63664
  derived and/or modified sequence opt1 from hemagglutinin__InfluenzaA__ADG27997

SEQ ID NO: 65822 - RNA, 1701 nt, Artificial Sequence; identical to SEQ ID NO: 63664
  derived and/or modified sequence opt1 from hemagglutinin__InfluenzaA__ADG28011

SEQ ID NO: 65823 - RNA, 1701 nt, Artificial Sequence; identical to SEQ ID NO: 65229
  derived and/or modified sequence opt1 from hemagglutinin__InfluenzaA__ADG42093

SEQ ID NO: 65824 - RNA, 1701 nt, Artificial Sequence; identical to SEQ ID NO: 64841
  derived and/or modified sequence opt1 from hemagglutinin__InfluenzaA__ADG42103

SEQ ID NO: 65825 - RNA, 1701 nt, Artificial Sequence; identical to SEQ ID NO: 64030
  derived and/or modified sequence opt1 from hemagglutinin__InfluenzaA__ADG42113

SEQ ID NO: 65826 - RNA, 1701 nt, Artificial Sequence; identical to SEQ ID NO: 65229
  derived and/or modified sequence opt1 from hemagglutinin__InfluenzaA__ADG42123

SEQ ID NO: 65827 - RNA, 1701 nt, Artificial Sequence
  derived and/or modified sequence opt1 from hemagglutinin__InfluenzaA__ADG42133
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccguacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgugaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 65828 - RNA, 1701 nt, Artificial Sequence
  derived and/or modified sequence opt1 from hemagglutinin__InfluenzaA__ADG42143
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagaagaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcgccuggcgaccggccuccggaacgucccgagcauccagucccgcgggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgcgaggagaucgacggcgucaagcuggaguccacccggaucuaccagauccucgcgaucuacagcaccgccgccagcucccuggugcugguggucagccucggggccaucuccuucuggaugugcagcaacggcucccugcagugccgcaucugcaucuga

SEQ ID NO: 65829 - RNA, 1701 nt, Artificial Sequence
  derived and/or modified sequence opt1 from hemagglutinin__InfluenzaA__ADG42153
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccuggacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65830 - RNA, 1701 nt, Artificial Sequence; identical to SEQ ID NO: 63677
  derived and/or modified sequence opt1 from hemagglutinin__InfluenzaA__ADG42193

SEQ ID NO: 65831 - RNA, 1701 nt, Artificial Sequence; identical to SEQ ID NO: 63677
  derived and/or modified sequence opt1 from hemagglutinin__InfluenzaA__ADG42213

SEQ ID NO: 65832 - RNA, 1701 nt, Artificial Sequence; identical to SEQ ID NO: 63677
  derived and/or modified sequence opt1 from hemagglutinin__InfluenzaA__ADG42233

SEQ ID NO: 65833 - RNA, 1701 nt, Artificial Sequence
  derived and/or modified sequence opt1 from hemagglutinin__InfluenzaA__ADG42243
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcuggacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 65834 - RNA, 1701 nt, Artificial Sequence; identical to SEQ ID NO: 65097
  derived and/or modified sequence opt1 from hemagglutinin__InfluenzaA__ADG42253

SEQ ID NO: 65835 - RNA, 1701 nt, Artificial Sequence; identical to SEQ ID NO: 63677
  derived and/or modified sequence opt1 from hemagglutinin__InfluenzaA__ADG42263

SEQ ID NO: 65836 - RNA, 1701 nt, Artificial Sequence; identical to SEQ ID NO: 64778
  derived and/or modified sequence opt1 from hemagglutinin__InfluenzaA__ADG42273

SEQ ID NO: 65837 - RNA, 1701 nt, Artificial Sequence; identical to SEQ ID NO: 64778
  derived and/or modified sequence opt1 from hemagglutinin__InfluenzaA__ADG42283

SEQ ID NO: 65838 - RNA, 1701 nt, Artificial Sequence; identical to SEQ ID NO: 65360
  derived and/or modified sequence opt1 from hemagglutinin__InfluenzaA__ADG42293

SEQ ID NO: 65839 - RNA, 1701 nt, Artificial Sequence
  derived and/or modified sequence opt1 from hemagglutinin__InfluenzaA__ADG42303
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggcgaucuacuccaccguggccagcagccuggugcucgucgugucccugggggccaucagcuucuggaugugcuccaacggcagccugcagugccgcaucugcaucuga

SEQ ID NO: 65840 - RNA, 1701 nt, Artificial Sequence; identical to SEQ ID NO: 65387
  derived and/or modified sequence opt1 from hemagglutinin__InfluenzaA__ADG42313

SEQ ID NO: 65841 - RNA, 1701 nt, Artificial Sequence
  derived and/or modified sequence opt1 from hemagglutinin__InfluenzaA__ADG42323
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65842 - RNA, 1701 nt, Artificial Sequence
  derived and/or modified sequence opt1 from hemagglutinin__InfluenzaA__ADG42333
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcaucgcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacgcccccguccacgacugcaacacgaccugccagaccccgaagggcgcgaucaacaccucccugcccuuccagaacauccaccccaucacgaucgggaagugccccaaguacgucaagagcaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcucaaccgggaggagaucgacggcgugaagcuggagagcacccgcaucuaccagauccuggccaucuacuccaccguggccagcagccucguccugguggugucccugggggccaucagcuucuggaugugcuccaacggcagccuccagugccggaucugcaucuga

SEQ ID NO: 65843 - RNA, 1701 nt, Artificial Sequence
  derived and/or modified sequence opt1 from hemagglutinin__InfluenzaA__ADG42343
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggaguccaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagcacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 65844 - RNA, 1701 nt, Artificial Sequence
  derived and/or modified sequence opt1 from hemagglutinin__InfluenzaA__ADG42363
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65845 - RNA, 1701 nt, Artificial Sequence
  derived and/or modified sequence opt1 from hemagglutinin__InfluenzaA__ADG42373
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65846 - RNA, 1701 nt, Artificial Sequence
  derived and/or modified sequence opt1 from hemagglutinin__InfluenzaA__ADG42393
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggagcaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcuccuggugucccugggcgccaucagcuucuggaugugcuccaacgggagccuccagugccggaucugcaucuga

SEQ ID NO: 65847 - RNA, 1701 nt, Artificial Sequence; identical to SEQ ID NO: 64841
  derived and/or modified sequence opt1 from hemagglutinin__InfluenzaA__ADG42403

SEQ ID NO: 65848 - RNA, 1701 nt, Artificial Sequence; identical to SEQ ID NO: 65097
  derived and/or modified sequence opt1 from hemagglutinin__InfluenzaA__ADG42413

SEQ ID NO: 65849 - RNA, 1701 nt, Artificial Sequence; identical to SEQ ID NO: 65844
  derived and/or modified sequence opt1 from hemagglutinin__InfluenzaA__ADG42423

SEQ ID NO: 65850 - RNA, 1701 nt, Artificial Sequence; identical to SEQ ID NO: 65097
  derived and/or modified sequence opt1 from hemagglutinin__InfluenzaA__ADG42443

SEQ ID NO: 65851 - RNA, 1701 nt, Artificial Sequence
  derived and/or modified sequence opt1 from hemagglutinin__InfluenzaA__ADG42453
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcgucgagaaccugaacaagaagguggacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccguggccagcagccuggugcuggucgugucccucggggccaucagcuucuggaugugcuccaacggcagccugcagugccggaucugcaucuga

SEQ ID NO: 65852 - RNA, 1701 nt, Artificial Sequence; identical to SEQ ID NO: 64030
  derived and/or modified sequence opt1 from hemagglutinin__InfluenzaA__ADG42463

SEQ ID NO: 65853 - RNA, 1701 nt, Artificial Sequence; identical to SEQ ID NO: 63677
  derived and/or modified sequence opt1 from hemagglutinin__InfluenzaA__ADG42473

SEQ ID NO: 65854 - RNA, 1701 nt, Artificial Sequence; identical to SEQ ID NO: 65097
  derived and/or modified sequence opt1 from hemagglutinin__InfluenzaA__ADG42483

SEQ ID NO: 65855 - RNA, 1701 nt, Artificial Sequence; identical to SEQ ID NO: 65229
  derived and/or modified sequence opt1 from hemagglutinin__InfluenzaA__ADG42493

SEQ ID NO: 65856 - RNA, 1701 nt, Artificial Sequence; identical to SEQ ID NO: 65290
  derived and/or modified sequence opt1 from hemagglutinin__InfluenzaA__ADG42503

SEQ ID NO: 65857 - RNA, 1701 nt, Artificial Sequence; identical to SEQ ID NO: 64778
  derived and/or modified sequence opt1 from hemagglutinin__InfluenzaA__ADG42513

SEQ ID NO: 65858 - RNA, 1701 nt, Artificial Sequence
  derived and/or modified sequence opt1 from hemagglutinin__InfluenzaA__ADG42533
augaaggccauccuggugguccuccuguacaccuucgccaccgcgaaggccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65859 - RNA, 1701 nt, Artificial Sequence
  derived and/or modified sequence opt1 from hemagglutinin__InfluenzaA__ADG42553
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugaacaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgccccaagguccgggagcaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65860 - RNA, 1701 nt, Artificial Sequence
  derived and/or modified sequence opt1 from hemagglutinin__InfluenzaA__ADG42573
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaagcucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65861 - RNA, 1701 nt, Artificial Sequence
  derived and/or modified sequence opt1 from hemagglutinin__InfluenzaA__ADG42583
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagcacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 65862 - RNA, 1701 nt, Artificial Sequence; identical to SEQ ID NO: 65274
  derived and/or modified sequence opt1 from hemagglutinin__InfluenzaA__ADG42593

SEQ ID NO: 65863 - RNA, 1701 nt, Artificial Sequence
  derived and/or modified sequence opt1 from hemagglutinin__InfluenzaA__ADG42603
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagcccgagaucgccacccggccgaagguccgcgaccaggagggccggaugaacuacuacuggacccugguggagcccggggacaagaucaccuucgaggcgacgggcaaccucguggucccccgcuacgccuucgccauggagcggaacgccgggagcggcaucaucaucuccgacacccccgugcacgacugcaacacgaccugccagaccccgaagggcagcaucaacaccucccugcccuuccagaacauccaccccaucaccaucgggaagugccccaaguacgucaagagcaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagcacgccaucgacgagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 65864 - RNA, 1701 nt, Artificial Sequence
  derived and/or modified sequence opt1 from hemagglutinin__InfluenzaA__ADG42613
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65865 - RNA, 1701 nt, Artificial Sequence; identical to SEQ ID NO: 65304
  derived and/or modified sequence opt1 from hemagglutinin__InfluenzaA__ADG42623

SEQ ID NO: 65866 - RNA, 1701 nt, Artificial Sequence; identical to SEQ ID NO: 63677
  derived and/or modified sequence opt1 from hemagglutinin__InfluenzaA__ADG42633

SEQ ID NO: 65867 - RNA, 1701 nt, Artificial Sequence
  derived and/or modified sequence opt1 from hemagglutinin__InfluenzaA__ADG42643
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcgccgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagauguuccccaagaccagcuccuggcccaaccacgacagcaacaagggggugaccgccgcgugcccgcacgccggcgccaaguccuucuacaagaaccugaucuggcucgugaagaaggggaacagcuaccccaagcuguccaagagcuacgucaacgacaagggcaaggaggugcuggugcucugggggauccaccaccccagcaccuccgccgaccagcagagccuguaccagaacgccgacgcguacgucuucgugggcacgucccgguacagcaagaaguucaagcccgagaucgccauccgcccgaaggugcgggaccaggagggccgcaugaacuacuacuggacccuggucgagcccggggacaagaucaccuucgaggccaccggcaaccucguggugccccgguacgccuucgccauggagcgcaacgcgggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgcggccgaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgcgaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggccagcagccugguccucguggugucccugggggcgaucagcuucuggaugugcuccaacggcagccugcagugccggaucugcaucuga

SEQ ID NO: 65868 - RNA, 1701 nt, Artificial Sequence
  derived and/or modified sequence opt1 from hemagglutinin__InfluenzaA__ADG42653
augaaggccauccuggugguccuccuguacaccagcgccaccgcgaacgccgacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgcguccagcugguccuacaucguggagaccagcuccagcgacaacggcacgugcuaccccggcgacuucaucgacuacgaggagcuccgggagcagcuguccagcguguccagcuucgagcgcuucgagauguuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65869 - RNA, 1701 nt, Artificial Sequence; identical to SEQ ID NO: 64841
  derived and/or modified sequence opt1 from hemagglutinin__InfluenzaA__ADG42663

SEQ ID NO: 65870 - RNA, 1701 nt, Artificial Sequence
  derived and/or modified sequence opt1 from hemagglutinin__InfluenzaA__ADG42673
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgcgggcagcugguccuacaucguggagaccagcuccagcgacaacggcacgugcuaccccggggacuucaucgacuacgaggagcuccgcgagcagcuguccagcguguccagcuucgagcgguucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgcuacuccaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcgccucgcgaccgggcugcggaacgucccgagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacggcaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggcgccaucuccuucuggaugugcagcaacgggucccugcagugccgcaucugcaucuga

SEQ ID NO: 65871 - RNA, 1701 nt, Artificial Sequence
  derived and/or modified sequence opt1 from hemagglutinin__InfluenzaA__ADG42683
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcaacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65872 - RNA, 1701 nt, Artificial Sequence; identical to SEQ ID NO: 64841
  derived and/or modified sequence opt1 from hemagglutinin__InfluenzaA__ADG42693

SEQ ID NO: 65873 - RNA, 1701 nt, Artificial Sequence; identical to SEQ ID NO: 65549
  derived and/or modified sequence opt1 from hemagglutinin__InfluenzaA__ADG42703

SEQ ID NO: 65874 - RNA, 1701 nt, Artificial Sequence
  derived and/or modified sequence opt1 from hemagglutinin__InfluenzaA__ADG42723
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagauggccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65875 - RNA, 1701 nt, Artificial Sequence; identical to SEQ ID NO: 65304
  derived and/or modified sequence opt1 from hemagglutinin__InfluenzaA__ADG42743

SEQ ID NO: 65876 - RNA, 1701 nt, Artificial Sequence
  derived and/or modified sequence opt1 from hemagglutinin__InfluenzaA__ADG42753
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacuccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgccagcucccuggugcucguggucagccugggggcgaucuccuucuggaugugcagcaacggcucccugcagugccggaucugcaucuga

SEQ ID NO: 65877 - RNA, 1701 nt, Artificial Sequence; identical to SEQ ID NO: 64841
  derived and/or modified sequence opt1 from hemagglutinin__InfluenzaA__ADG42763

SEQ ID NO: 65878 - RNA, 1701 nt, Artificial Sequence; identical to SEQ ID NO: 64841
  derived and/or modified sequence opt1 from hemagglutinin__InfluenzaA__ADG42773

SEQ ID NO: 65879 - RNA, 1701 nt, Artificial Sequence
  derived and/or modified sequence opt1 from hemagglutinin__InfluenzaA__ADG42783
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 65880 - RNA, 1701 nt, Artificial Sequence; identical to SEQ ID NO: 64841
  derived and/or modified sequence opt1 from hemagglutinin__InfluenzaA__ADG42793

SEQ ID NO: 65881 - RNA, 1701 nt, Artificial Sequence; identical to SEQ ID NO: 65879
  derived and/or modified sequence opt1 from hemagglutinin__InfluenzaA__ADG42803

SEQ ID NO: 65882 - RNA, 1701 nt, Artificial Sequence; identical to SEQ ID NO: 65229
  derived and/or modified sequence opt1 from hemagglutinin__InfluenzaA__ADG42813

SEQ ID NO: 65883 - RNA, 1701 nt, Artificial Sequence; identical to SEQ ID NO: 65372
  derived and/or modified sequence opt1 from hemagglutinin__InfluenzaA__ADG42823

SEQ ID NO: 65884 - RNA, 1701 nt, Artificial Sequence; identical to SEQ ID NO: 65274
  derived and/or modified sequence opt1 from hemagglutinin__InfluenzaA__ADG42833

SEQ ID NO: 65885 - RNA, 1701 nt, Artificial Sequence; identical to SEQ ID NO: 64841
  derived and/or modified sequence opt1 from hemagglutinin__InfluenzaA__ADG42843

SEQ ID NO: 65886 - RNA, 1701 nt, Artificial Sequence; identical to SEQ ID NO: 64841
  derived and/or modified sequence opt1 from hemagglutinin__InfluenzaA__ADG42853

SEQ ID NO: 65887 - RNA, 1701 nt, Artificial Sequence; identical to SEQ ID NO: 65395
  derived and/or modified sequence opt1 from hemagglutinin__InfluenzaA__ADG42863

SEQ ID NO: 65888 - RNA, 1701 nt, Artificial Sequence; identical to SEQ ID NO: 65415
  derived and/or modified sequence opt1 from hemagglutinin__InfluenzaA__ADG42883

SEQ ID NO: 65889 - RNA, 1701 nt, Artificial Sequence
  derived and/or modified sequence opt1 from hemagglutinin__InfluenzaA__ADG42893
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaaccugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65890 - RNA, 1701 nt, Artificial Sequence; identical to SEQ ID NO: 63677
  derived and/or modified sequence opt1 from hemagglutinin__InfluenzaA__ADG42903

SEQ ID NO: 65891 - RNA, 1701 nt, Artificial Sequence; identical to SEQ ID NO: 64841
  derived and/or modified sequence opt1 from hemagglutinin__InfluenzaA__ADG42913

SEQ ID NO: 65892 - RNA, 1701 nt, Artificial Sequence; identical to SEQ ID NO: 65405
  derived and/or modified sequence opt1 from hemagglutinin__InfluenzaA__ADG42923

SEQ ID NO: 65893 - RNA, 1701 nt, Artificial Sequence
  derived and/or modified sequence opt1 from hemagglutinin__InfluenzaA__ADG57087
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccaucagccuggugcucguggucagccugggggccaucuccuucuggaugugcagcaacggcucccugcggugccgcaucugcaucuga

SEQ ID NO: 65894 - RNA, 1701 nt, Artificial Sequence; identical to SEQ ID NO: 63677
  derived and/or modified sequence opt1 from hemagglutinin__InfluenzaA__ADG57088

SEQ ID NO: 65895 - RNA, 1701 nt, Artificial Sequence
  derived and/or modified sequence opt1 from hemagglutinin__InfluenzaA__ADG57089
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucauccaguacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccgaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65896 - RNA, 1701 nt, Artificial Sequence
  derived and/or modified sequence opt1 from hemagglutinin__InfluenzaA__ADG57090
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagcaucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgcccagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 65897 - RNA, 1701 nt, Artificial Sequence
  derived and/or modified sequence opt1 from hemagglutinin__InfluenzaA__ADG57091
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagcgcggcuggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacgggucccugcagugccgcaucugcaucuga

SEQ ID NO: 65898 - RNA, 1701 nt, Artificial Sequence
  derived and/or modified sequence opt1 from hemagglutinin__InfluenzaA__ADG57092
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaucaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65899 - RNA, 1701 nt, Artificial Sequence
  derived and/or modified sequence opt1 from hemagglutinin__InfluenzaA__ADG57093
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggagauccuggugcucugggggauccaccaccccagcaccuccgccgaccagcagagccuguaccagaacgccgacgccuacgucuucgugugguccagccgguacuccaagaaguucaagcccgagaucgccauccgcccgaaggugcgggaccaggagggccgcaugaacuacuacuggacgcuggucgagcccggcgacaagaucaccuucgaggcgaccgggaaccuccuggugccccgguacgccuucgccauggagcgcaacgccggcagcgggaucaucaucuccgacacccccgugcacgacugcaacacgaccugccagaccccgaagggcgccaucaacaccagccugcccuuccacaacauccaccccaucacgaucggcaagugccccaaguacgucaaguccaccaagcuccggcuggcgaccgggcugcgcaacgugccgagcauccagucccggggccucuucggggccaucgccggcuucaucgagggcggguggaccggcaugguggacgggugguacggcuaccaccaccagaacgagcaggggagcggcuacgccgccgaccugaaguccacgcagaacgcgaucgacgagaucaccaacaaggucaacagcgugaucgagaagaugaacacccaguucaccgccguggggaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgucaagaaccuguacgagaaggugcgcagccagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgggaggagaucgacggggucaagcuggaguccacccgcaucuaccagauccuggcgaucuacagcaccguggccagcucccucgugcuggucgugagccugggcgccaucuccuucuggaugugcagcaacgggucccuccagugccggaucugcaucuga

SEQ ID NO: 65900 - RNA, 1701 nt, Artificial Sequence
  derived and/or modified sequence opt1 from hemagglutinin__InfluenzaA__ADG57094
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccgcgagggccggaugaacuacuacuggacccugguggagcccggggacaagaucaccuucgaggcgaccggcaaccucgucgugccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggcgaucuacuccaccguggccagcagccuggugcucgucgugucccugggggccaucagcuucuggaugugcuccaacggcagccugcagugccgcaucugcaucuga

SEQ ID NO: 65901 - RNA, 1701 nt, Artificial Sequence; identical to SEQ ID NO: 63677
  derived and/or modified sequence opt1 from hemagglutinin__InfluenzaA__ADG57095

SEQ ID NO: 65902 - RNA, 1701 nt, Artificial Sequence
  derived and/or modified sequence opt1 from hemagglutinin__InfluenzaA__ADG57097
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccagccugcccuuccacaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 65903 - RNA, 1701 nt, Artificial Sequence; identical to SEQ ID NO: 64841
  derived and/or modified sequence opt1 from hemagglutinin__InfluenzaA__ADG57098

SEQ ID NO: 65904 - RNA, 1701 nt, Artificial Sequence
  derived and/or modified sequence opt1 from hemagglutinin__InfluenzaA__ADG57099
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucacggacacccccgugcacgacugcaacacgaccugccagaccccgaagggcgccgugaacaccagccugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 65905 - RNA, 1701 nt, Artificial Sequence
  derived and/or modified sequence opt1 from hemagglutinin__InfluenzaA__ADG57100
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccggcggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 65906 - RNA, 1701 nt, Artificial Sequence; identical to SEQ ID NO: 63677
  derived and/or modified sequence opt1 from hemagglutinin__InfluenzaA__ADG58939

SEQ ID NO: 65907 - RNA, 1701 nt, Artificial Sequence; identical to SEQ ID NO: 63677
  derived and/or modified sequence opt1 from hemagglutinin__InfluenzaA__ADG58940

SEQ ID NO: 65908 - RNA, 1701 nt, Artificial Sequence
  derived and/or modified sequence opt1 from hemagglutinin__InfluenzaA__ADG58941
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccacgagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 65909 - RNA, 1701 nt, Artificial Sequence
  derived and/or modified sequence opt1 from hemagglutinin__InfluenzaA__ADG58942
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccuccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggccaucuacuccaccguggcgagcagccucguccugguggugucccugggggccaucagcuucuggaugugcuccaacggcagccuccagugccggaucugcaucuga

SEQ ID NO: 65910 - RNA, 1701 nt, Artificial Sequence; identical to SEQ ID NO: 63677
  derived and/or modified sequence opt1 from hemagglutinin__InfluenzaA__ADG58943

SEQ ID NO: 65911 - RNA, 1701 nt, Artificial Sequence
  derived and/or modified sequence opt1 from hemagglutinin__InfluenzaA__ADG58944
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65912 - RNA, 1701 nt, Artificial Sequence; identical to SEQ ID NO: 64475
  derived and/or modified sequence opt1 from hemagglutinin__InfluenzaA__ADG58946

SEQ ID NO: 65913 - RNA, 1701 nt, Artificial Sequence; identical to SEQ ID NO: 63677
  derived and/or modified sequence opt1 from hemagglutinin__InfluenzaA__ADG58947

SEQ ID NO: 65914 - RNA, 1701 nt, Artificial Sequence
  derived and/or modified sequence opt1 from hemagglutinin__InfluenzaA__ADG58948
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacacguacgucuucgugggcaccucccgguacagcaagaaguucaagcccgagaucgccauccgcccgaaggugcgggaccaggagggccgcaugaacuacuacuggacccuggucgagcccggggacaagaucaccuucgaggccacgggcaaccucguggugccccgguacgcguucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 65915 - RNA, 1701 nt, Artificial Sequence
  derived and/or modified sequence opt1 from hemagglutinin__InfluenzaA__ADG58949
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacaccuccgugcacgacugcaacacgaccugccagacccccaagggcgccaucaacaccagccugccguuccagaacauccaccccaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacagcgaggaggccaagcugaaccgggaggagaucgacggcgugaagcucgaguccacccgcaucuaccagauccuggccaucuacagcaccguggcgagcucccugguccucguggugagccugggggccaucuccuucuggaugugcagcaacggcucccugcagugccggaucugcaucuga

SEQ ID NO: 65916 - RNA, 1701 nt, Artificial Sequence
  derived and/or modified sequence opt1 from hemagglutinin__InfluenzaA__ADG58951
augaaggccauccuggugguccuccugcacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcggcaacggcacgugcuaccccggggaguucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcaucgaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65917 - RNA, 1701 nt, Artificial Sequence; identical to SEQ ID NO: 65916
  derived and/or modified sequence opt1 from hemagglutinin__InfluenzaA__ADG58952

SEQ ID NO: 65918 - RNA, 1701 nt, Artificial Sequence; identical to SEQ ID NO: 65916
  derived and/or modified sequence opt1 from hemagglutinin__InfluenzaA__ADG58953

SEQ ID NO: 65919 - RNA, 1701 nt, Artificial Sequence; identical to SEQ ID NO: 65916
  derived and/or modified sequence opt1 from hemagglutinin__InfluenzaA__ADG58954

SEQ ID NO: 65920 - RNA, 1701 nt, Artificial Sequence; identical to SEQ ID NO: 65916
  derived and/or modified sequence opt1 from hemagglutinin__InfluenzaA__ADG58955

SEQ ID NO: 65921 - RNA, 1701 nt, Artificial Sequence; identical to SEQ ID NO: 65916
  derived and/or modified sequence opt1 from hemagglutinin__InfluenzaA__ADG58956

SEQ ID NO: 65922 - RNA, 1701 nt, Artificial Sequence
  derived and/or modified sequence opt1 from hemagglutinin__InfluenzaA__ADG58957
augaaggccauccuggugguccuccugcacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcggcaacggcacgugcuaccccggggaguucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65923 - RNA, 1701 nt, Artificial Sequence
  derived and/or modified sequence opt1 from hemagglutinin__InfluenzaA__ADG58959
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 65924 - RNA, 1701 nt, Artificial Sequence; identical to SEQ ID NO: 65841
  derived and/or modified sequence opt1 from hemagglutinin__InfluenzaA__ADG58960

SEQ ID NO: 65925 - RNA, 1701 nt, Artificial Sequence; identical to SEQ ID NO: 65841
  derived and/or modified sequence opt1 from hemagglutinin__InfluenzaA__ADG58961

SEQ ID NO: 65926 - RNA, 1701 nt, Artificial Sequence; identical to SEQ ID NO: 65841
  derived and/or modified sequence opt1 from hemagglutinin__InfluenzaA__ADG58962

SEQ ID NO: 65927 - RNA, 1701 nt, Artificial Sequence; identical to SEQ ID NO: 65841
  derived and/or modified sequence opt1 from hemagglutinin__InfluenzaA__ADG58963

SEQ ID NO: 65928 - RNA, 1701 nt, Artificial Sequence; identical to SEQ ID NO: 65841
  derived and/or modified sequence opt1 from hemagglutinin__InfluenzaA__ADG58964

SEQ ID NO: 65929 - RNA, 1701 nt, Artificial Sequence; identical to SEQ ID NO: 65841
  derived and/or modified sequence opt1 from hemagglutinin__InfluenzaA__ADG58965

SEQ ID NO: 65930 - RNA, 1701 nt, Artificial Sequence; identical to SEQ ID NO: 65841
  derived and/or modified sequence opt1 from hemagglutinin__InfluenzaA__ADG58966

SEQ ID NO: 65931 - RNA, 1701 nt, Artificial Sequence; identical to SEQ ID NO: 65841
  derived and/or modified sequence opt1 from hemagglutinin__InfluenzaA__ADG58967

SEQ ID NO: 65932 - RNA, 1701 nt, Artificial Sequence; identical to SEQ ID NO: 65841
  derived and/or modified sequence opt1 from hemagglutinin__InfluenzaA__ADG58968

SEQ ID NO: 65933 - RNA, 1701 nt, Artificial Sequence; identical to SEQ ID NO: 63677
  derived and/or modified sequence opt1 from hemagglutinin__InfluenzaA__ADG59628

SEQ ID NO: 65934 - RNA, 1701 nt, Artificial Sequence; identical to SEQ ID NO: 63677
  derived and/or modified sequence opt1 from hemagglutinin__InfluenzaA__ADG59629

SEQ ID NO: 65935 - RNA, 1701 nt, Artificial Sequence; identical to SEQ ID NO: 63677
  derived and/or modified sequence opt1 from hemagglutinin__InfluenzaA__ADG59630

SEQ ID NO: 65936 - RNA, 1701 nt, Artificial Sequence; identical to SEQ ID NO: 63677
  derived and/or modified sequence opt1 from hemagglutinin__InfluenzaA__ADG59631

SEQ ID NO: 65937 - RNA, 1701 nt, Artificial Sequence; identical to SEQ ID NO: 63677
  derived and/or modified sequence opt1 from hemagglutinin__InfluenzaA__ADG59632

SEQ ID NO: 65938 - RNA, 1701 nt, Artificial Sequence; identical to SEQ ID NO: 64778
  derived and/or modified sequence opt1 from hemagglutinin__InfluenzaA__ADG59633

SEQ ID NO: 65939 - RNA, 1701 nt, Artificial Sequence; identical to SEQ ID NO: 64778
  derived and/or modified sequence opt1 from hemagglutinin__InfluenzaA__ADG59634

SEQ ID NO: 65940 - RNA, 1701 nt, Artificial Sequence; identical to SEQ ID NO: 63677
  derived and/or modified sequence opt1 from hemagglutinin__InfluenzaA__ADG59635

SEQ ID NO: 65941 - RNA, 1701 nt, Artificial Sequence
  derived and/or modified sequence opt1 from hemagglutinin__InfluenzaA__ADG59636
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 65942 - RNA, 1701 nt, Artificial Sequence; identical to SEQ ID NO: 64425
  derived and/or modified sequence opt1 from hemagglutinin__InfluenzaA__ADG59638

SEQ ID NO: 65943 - RNA, 1701 nt, Artificial Sequence; identical to SEQ ID NO: 64778
  derived and/or modified sequence opt1 from hemagglutinin__InfluenzaA__ADG59639

SEQ ID NO: 65944 - RNA, 1701 nt, Artificial Sequence; identical to SEQ ID NO: 64030
  derived and/or modified sequence opt1 from hemagglutinin__InfluenzaA__ADG59641

SEQ ID NO: 65945 - RNA, 1701 nt, Artificial Sequence; identical to SEQ ID NO: 64520
  derived and/or modified sequence opt1 from hemagglutinin__InfluenzaA__ADG59643

SEQ ID NO: 65946 - RNA, 1701 nt, Artificial Sequence; identical to SEQ ID NO: 63664
  derived and/or modified sequence opt1 from hemagglutinin__InfluenzaA__ADG59644

SEQ ID NO: 65947 - RNA, 1701 nt, Artificial Sequence; identical to SEQ ID NO: 63677
  derived and/or modified sequence opt1 from hemagglutinin__InfluenzaA__ADG59646

SEQ ID NO: 65948 - RNA, 1701 nt, Artificial Sequence; identical to SEQ ID NO: 64778
  derived and/or modified sequence opt1 from hemagglutinin__InfluenzaA__ADG59647

SEQ ID NO: 65949 - RNA, 1701 nt, Artificial Sequence; identical to SEQ ID NO: 64841
  derived and/or modified sequence opt1 from hemagglutinin__InfluenzaA__ADG59648

SEQ ID NO: 65950 - RNA, 1701 nt, Artificial Sequence; identical to SEQ ID NO: 64841
  derived and/or modified sequence opt1 from hemagglutinin__InfluenzaA__ADG59649

SEQ ID NO: 65951 - RNA, 1701 nt, Artificial Sequence; identical to SEQ ID NO: 64841
  derived and/or modified sequence opt1 from hemagglutinin__InfluenzaA__ADG59650

SEQ ID NO: 65952 - RNA, 1701 nt, Artificial Sequence; identical to SEQ ID NO: 64841
  derived and/or modified sequence opt1 from hemagglutinin__InfluenzaA__ADG59651

SEQ ID NO: 65953 - RNA, 1701 nt, Artificial Sequence; identical to SEQ ID NO: 63677
  derived and/or modified sequence opt1 from hemagglutinin__InfluenzaA__ADG59652

SEQ ID NO: 65954 - RNA, 1701 nt, Artificial Sequence; identical to SEQ ID NO: 63677
  derived and/or modified sequence opt1 from hemagglutinin__InfluenzaA__ADG59653

SEQ ID NO: 65955 - RNA, 1701 nt, Artificial Sequence; identical to SEQ ID NO: 65941
  derived and/or modified sequence opt1 from hemagglutinin__InfluenzaA__ADG59655

SEQ ID NO: 65956 - RNA, 1701 nt, Artificial Sequence; identical to SEQ ID NO: 64778
  derived and/or modified sequence opt1 from hemagglutinin__InfluenzaA__ADG59656

SEQ ID NO: 65957 - RNA, 1701 nt, Artificial Sequence
  derived and/or modified sequence opt1 from hemagglutinin__InfluenzaA__ADG59657
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcacccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 65958 - RNA, 1701 nt, Artificial Sequence
  derived and/or modified sequence opt1 from hemagglutinin__InfluenzaA__ADG59658
augaaggccauccuggugguccuccuguacaccuucgccaccgcgaacgccgacacgcugugcaucggcuaccacgccaacaacagcaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcggaaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65959 - RNA, 1701 nt, Artificial Sequence; identical to SEQ ID NO: 64124
  derived and/or modified sequence opt1 from hemagglutinin__InfluenzaA__ADG59659

SEQ ID NO: 65960 - RNA, 1701 nt, Artificial Sequence; identical to SEQ ID NO: 64124
  derived and/or modified sequence opt1 from hemagglutinin__InfluenzaA__ADG59660

SEQ ID NO: 65961 - RNA, 1701 nt, Artificial Sequence; identical to SEQ ID NO: 64030
  derived and/or modified sequence opt1 from hemagglutinin__InfluenzaA__ADG59662

SEQ ID NO: 65962 - RNA, 1701 nt, Artificial Sequence
  derived and/or modified sequence opt1 from hemagglutinin__InfluenzaA__ADG59663
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccuuccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65963 - RNA, 1701 nt, Artificial Sequence; identical to SEQ ID NO: 64030
  derived and/or modified sequence opt1 from hemagglutinin__InfluenzaA__ADG59664

SEQ ID NO: 65964 - RNA, 1701 nt, Artificial Sequence
  derived and/or modified sequence opt1 from hemagglutinin__InfluenzaA__ADG59666
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccgccguggccagcagccugguccucguggugucccugggggccaucagcuucuggaugugcuccaacggcagccugcagugccggaucugcaucuga

SEQ ID NO: 65965 - RNA, 1701 nt, Artificial Sequence; identical to SEQ ID NO: 64779
  derived and/or modified sequence opt1 from hemagglutinin__InfluenzaA__ADG59667

SEQ ID NO: 65966 - RNA, 1701 nt, Artificial Sequence
  derived and/or modified sequence opt1 from hemagglutinin__InfluenzaA__ADG59669
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggaccccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65967 - RNA, 1701 nt, Artificial Sequence; identical to SEQ ID NO: 65966
  derived and/or modified sequence opt1 from hemagglutinin__InfluenzaA__ADG59670

SEQ ID NO: 65968 - RNA, 1701 nt, Artificial Sequence; identical to SEQ ID NO: 65966
  derived and/or modified sequence opt1 from hemagglutinin__InfluenzaA__ADG59671

SEQ ID NO: 65969 - RNA, 1701 nt, Artificial Sequence; identical to SEQ ID NO: 65966
  derived and/or modified sequence opt1 from hemagglutinin__InfluenzaA__ADG59672

SEQ ID NO: 65970 - RNA, 1701 nt, Artificial Sequence
  derived and/or modified sequence opt1 from hemagglutinin__InfluenzaA__ADG59673
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucggggagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65971 - RNA, 1701 nt, Artificial Sequence
  derived and/or modified sequence opt1 from hemagglutinin__InfluenzaA__ADG59674
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggagcaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacguccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcaccaagaucuaccagauccuggcgaucuacuccaccguggccagcagccugguccucguggugucccugggggccaucagcuucuggaugugcuccaacggcagccugcagugccgcaucugcaucuga

SEQ ID NO: 65972 - RNA, 1701 nt, Artificial Sequence
  derived and/or modified sequence opt1 from hemagglutinin__InfluenzaA__ADG59675
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaacggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 65973 - RNA, 1701 nt, Artificial Sequence
  derived and/or modified sequence opt1 from hemagglutinin__InfluenzaA__ADG59676
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacgcgaccugccagaccccgaagggcgccaucaacaccucccugcccuuccagaacauccaccccaucacgaucgggaagugccccaaguacgucaagagcaccaagcugcggcucgccaccggccugcgcaacaucccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 65974 - RNA, 1701 nt, Artificial Sequence; identical to SEQ ID NO: 64778
  derived and/or modified sequence opt1 from hemagglutinin__InfluenzaA__ADG59678

SEQ ID NO: 65975 - RNA, 1701 nt, Artificial Sequence; identical to SEQ ID NO: 65941
  derived and/or modified sequence opt1 from hemagglutinin__InfluenzaA__ADG59680

SEQ ID NO: 65976 - RNA, 1701 nt, Artificial Sequence; identical to SEQ ID NO: 65941
  derived and/or modified sequence opt1 from hemagglutinin__InfluenzaA__ADG59681

SEQ ID NO: 65977 - RNA, 1701 nt, Artificial Sequence
  derived and/or modified sequence opt1 from hemagglutinin__InfluenzaA__ADG59683
augaaggccauccuggugguccuccuguacaccuucgccaucgcgaacgccgacacccugugcaucggcuaccacgccaacaacagcacggacaccguggacaccgugcucaagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucgugaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggucaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65978 - RNA, 1701 nt, Artificial Sequence; identical to SEQ ID NO: 64778
  derived and/or modified sequence opt1 from hemagglutinin__InfluenzaA__ADG59684

SEQ ID NO: 65979 - RNA, 1701 nt, Artificial Sequence
  derived and/or modified sequence opt1 from hemagglutinin__InfluenzaA__ADG59685
augaaggccauccuggugguccuccuguacaccuucgccaccgcgaacgccgacacgcugugcaucggcuaccacgccaacaacagcaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 65980 - RNA, 1701 nt, Artificial Sequence; identical to SEQ ID NO: 64778
  derived and/or modified sequence opt1 from hemagglutinin__InfluenzaA__ADG59686

SEQ ID NO: 65981 - RNA, 1701 nt, Artificial Sequence; identical to SEQ ID NO: 65941
  derived and/or modified sequence opt1 from hemagglutinin__InfluenzaA__ADG59687

SEQ ID NO: 65982 - RNA, 1701 nt, Artificial Sequence
  derived and/or modified sequence opt1 from hemagglutinin__InfluenzaA__ADG59688
augaaggccauccuggugguccuccuguacaccaucgccaccgcgaacgccgacacgcugugcaucggcuaccacgccaacaacagcaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcggggccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaacggcagccugcagugccggaucugcaucuga

SEQ ID NO: 65983 - RNA, 1701 nt, Artificial Sequence; identical to SEQ ID NO: 63677
  derived and/or modified sequence opt1 from hemagglutinin__InfluenzaA__ADG59689

SEQ ID NO: 65984 - RNA, 1701 nt, Artificial Sequence; identical to SEQ ID NO: 63677
  derived and/or modified sequence opt1 from hemagglutinin__InfluenzaA__ADG59691

SEQ ID NO: 65985 - RNA, 1701 nt, Artificial Sequence
  derived and/or modified sequence opt1 from hemagglutinin__InfluenzaA__ADG59693
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65986 - RNA, 1701 nt, Artificial Sequence
  derived and/or modified sequence opt1 from hemagglutinin__InfluenzaA__ADG59696
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 65987 - RNA, 1701 nt, Artificial Sequence
  derived and/or modified sequence opt1 from hemagglutinin__InfluenzaA__ADG59697
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagaacuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 65988 - RNA, 1701 nt, Artificial Sequence
  derived and/or modified sequence opt1 from hemagglutinin__InfluenzaA__ADG59700
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagacccugaagggcgccaucaacaccucccugccguuccagaacauccaccccaucaccaucgggaagugccccaaguacgucaagagcaccaagcuccggcuggcgaccggccugcgcaacauccccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuacccgaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 65989 - RNA, 1701 nt, Artificial Sequence
  derived and/or modified sequence opt1 from hemagglutinin__InfluenzaA__ADG59701
augaaggccauccuggugguccuccuguacaccuucgccgcggccaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 65990 - RNA, 1701 nt, Artificial Sequence
  derived and/or modified sequence opt1 from hemagglutinin__InfluenzaA__ADG59702
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggaaccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 65991 - RNA, 1701 nt, Artificial Sequence
  derived and/or modified sequence opt1 from hemagglutinin__InfluenzaA__ADG59703
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucgugaucuccgacacgccggugcacgacugcaacacgaccugccagacccccaagggcgccaucaacaccagccugcccuuccagaacauccaccccaucaccaucgggaagugcccgaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 65992 - RNA, 1701 nt, Artificial Sequence; identical to SEQ ID NO: 63692
  derived and/or modified sequence opt1 from hemagglutinin__InfluenzaA__ADG76646

SEQ ID NO: 65993 - RNA, 1701 nt, Artificial Sequence
  derived and/or modified sequence opt1 from hemagglutinin__InfluenzaA__ADG76652
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagacccccagcuccgacaacggcacgugcuaccccggcgacuucaucgacuacgaggagcugcgggagcagcucagcuccgugagcuccuucgagcgcuucgagaucuuccccaagaccagcuccuggccgaaccacgacagcaacaagggggucaccgccgccugcccccacgccggcgccaaguccuucuacaagaaccugaucuggcuggugaagaaggggaacagcuaccccaagcucuccaagagcuacaucaacgacaagggcaaggaggugcugguccugugggggauccaccaccccagcaccuccgcggaccagcagagccucuaccagaacgccgacacguacguguucgugggcuccagccgguacuccaagaaguucaagccggagaucgccauccgccccaagguccgggaccaggagggccgcaugaacuacuacuggacccugguggagcccggggacaagaucaccuucgaggccaccggcaaccugguggucccccgguacgccuucgcgauggagcgcaacgccgggagcggcaucaucaucuccgacacgccggugcacgacugcaacacgaccugccagacccccaagggcgccaucaacaccagccuccccuuccagaacauccaccccaucaccaucgggaagugcccgaaguacgugaaguccaccaagcugcggcuggccaccggccuccgcaacauccccagcauccagucccgggggcuguucggcgccaucgcgggguucaucgagggcggcuggacggggauggucgacggcugguacggguaccaccaccagaacgagcagggcagcggguacgccgccgaccugaaguccacccagaacgccaucgacgagaucaccaacaaggugaacagcgugaucgagaagaugaacacccaguucacggccgucggcaaggaguucaaccaccucgagaagcgcaucgagaaccugaacaagaagguggacgacggcuuccuggacaucuggaccuacaacgcggagcuccugguccugcucgagaacgagcggacccuggacuaccacgacuccaacgugaagaaccuguacgagaaggugcgcagccagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgccaucuacagcaccguggccagcucccugguccugguggugagccucggggcgaucuccuucuggaugugcagcaacggcucccugcagugccggaucugcaucuga

SEQ ID NO: 65994 - RNA, 1701 nt, Artificial Sequence; identical to SEQ ID NO: 63919
  derived and/or modified sequence opt1 from hemagglutinin__InfluenzaA__ADH01808

SEQ ID NO: 65995 - RNA, 1701 nt, Artificial Sequence
  derived and/or modified sequence opt1 from hemagglutinin__InfluenzaA__ADH01818
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucaucgugucccugggggccaucagcuucuggaugugcuccaacggcagccugcagugccggaucugcaucuga

SEQ ID NO: 65996 - RNA, 1701 nt, Artificial Sequence; identical to SEQ ID NO: 63919
  derived and/or modified sequence opt1 from hemagglutinin__InfluenzaA__ADH01828

SEQ ID NO: 65997 - RNA, 1701 nt, Artificial Sequence; identical to SEQ ID NO: 63677
  derived and/or modified sequence opt1 from hemagglutinin__InfluenzaA__ADH01838

SEQ ID NO: 65998 - RNA, 1701 nt, Artificial Sequence; identical to SEQ ID NO: 63919
  derived and/or modified sequence opt1 from hemagglutinin__InfluenzaA__ADH01848

SEQ ID NO: 65999 - RNA, 1701 nt, Artificial Sequence; identical to SEQ ID NO: 63919
  derived and/or modified sequence opt1 from hemagglutinin__InfluenzaA__ADH01858

SEQ ID NO: 66000 - RNA, 1701 nt, Artificial Sequence; identical to SEQ ID NO: 63677
  derived and/or modified sequence opt1 from hemagglutinin__InfluenzaA__ADH01868

SEQ ID NO: 66001 - RNA, 1701 nt, Artificial Sequence; identical to SEQ ID NO: 63677
  derived and/or modified sequence opt1 from hemagglutinin__InfluenzaA__ADH01878

SEQ ID NO: 66002 - RNA, 1701 nt, Artificial Sequence; identical to SEQ ID NO: 63919
  derived and/or modified sequence opt1 from hemagglutinin__InfluenzaA__ADH01888

SEQ ID NO: 66003 - RNA, 1701 nt, Artificial Sequence; identical to SEQ ID NO: 63677
  derived and/or modified sequence opt1 from hemagglutinin__InfluenzaA__ADH01898

SEQ ID NO: 66004 - RNA, 1701 nt, Artificial Sequence; identical to SEQ ID NO: 63768
  derived and/or modified sequence opt1 from hemagglutinin__InfluenzaA__ADH01908

SEQ ID NO: 66005 - RNA, 1701 nt, Artificial Sequence
  derived and/or modified sequence opt1 from hemagglutinin__InfluenzaA__ADH01918
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgagagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaaggagaaggaggugcugguccucuggggcauccaccaccccagcaccuccgcggaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggccaccgggaaccucguggucccccgguacgcguucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgccaccgggcugcgcaacgugccguccauccagagccggggccuguucggggcgaucgccggcuucaucgagggcggguggacgggcaugguggacgggugguacggcuaccaccaccagaacgagcagggguccggcuacgccgccgaccucaagagcacccagaacgccaucgacaagaucaccaacaaggugaacuccgucaucgagaagaugaacacccaguucacggcgguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacgggagccugcagugccggaucugcaucuga

SEQ ID NO: 66006 - RNA, 1701 nt, Artificial Sequence
  derived and/or modified sequence opt1 from hemagglutinin__InfluenzaA__ADH01928
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgccagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacaucccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgucaagcucgagagcacccgcaucuaccagauccuggccaucuacuccaccguggccagcagccuggugcucgucgugucccugggggccaucagcuucuggaugugcuccaacggcagccugcagugccggaucugcaucuga

SEQ ID NO: 66007 - RNA, 1701 nt, Artificial Sequence
  derived and/or modified sequence opt1 from hemagglutinin__InfluenzaA__ADH01938
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacaagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66008 - RNA, 1701 nt, Artificial Sequence; identical to SEQ ID NO: 64841
  derived and/or modified sequence opt1 from hemagglutinin__InfluenzaA__ADH01948

SEQ ID NO: 66009 - RNA, 1701 nt, Artificial Sequence
  derived and/or modified sequence opt1 from hemagglutinin__InfluenzaA__ADH01958
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaacugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucaucgugucccugggggccaucagcuucuggaugugcuccaacggcagccugcagugccggaucugcaucuga

SEQ ID NO: 66010 - RNA, 1701 nt, Artificial Sequence
  derived and/or modified sequence opt1 from hemagglutinin__InfluenzaA__ADH01968
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66011 - RNA, 1701 nt, Artificial Sequence; identical to SEQ ID NO: 64841
  derived and/or modified sequence opt1 from hemagglutinin__InfluenzaA__ADH01978

SEQ ID NO: 66012 - RNA, 1701 nt, Artificial Sequence; identical to SEQ ID NO: 64841
  derived and/or modified sequence opt1 from hemagglutinin__InfluenzaA__ADH01988

SEQ ID NO: 66013 - RNA, 1701 nt, Artificial Sequence; identical to SEQ ID NO: 65844
  derived and/or modified sequence opt1 from hemagglutinin__InfluenzaA__ADH01998

SEQ ID NO: 66014 - RNA, 1701 nt, Artificial Sequence
  derived and/or modified sequence opt1 from hemagglutinin__InfluenzaA__ADH02008
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucaucaagaagggcaacagcuaccccaagcuguccaagagcuacaucaacgacaaggagaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66015 - RNA, 1701 nt, Artificial Sequence; identical to SEQ ID NO: 64841
  derived and/or modified sequence opt1 from hemagglutinin__InfluenzaA__ADI24508

SEQ ID NO: 66016 - RNA, 1701 nt, Artificial Sequence
  derived and/or modified sequence opt1 from hemagglutinin__InfluenzaA__ADI24515
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccugcccaccgcguccagcugguccuacaucguggagaccagcuccagcgacaacggcacgugcuaccccggcgacuucaucgacuacgaggagcuccgggagcagcuguccagcgucuccagcuucgagcgcuucgagaucuuccccaagaccuccagcuggccgaaccacgacuccaacaagggggugaccgccgccugcccccacgccggcgccaagagcuucuacaagaaccugaucuggcucgugaagaaggggaacuccuaccccaagcugagcaaguccuacaucaacgacaagggcaaggagguccuggugcucugggggauccaccaccccagcaccagcgccgaccagcagucccuguaccagaacgccgacgccuacguguucgucggcacgagccgguacuccaagaaguucaagccggagaucgccauccgccccaaggugcgggaccaggagggccgcaugaacuacuacuggacccugguggagcccggggacaagaucaccuucgaggcgaccggcaaccucgucgugccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagagcaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66017 - RNA, 1701 nt, Artificial Sequence; identical to SEQ ID NO: 64841
  derived and/or modified sequence opt1 from hemagglutinin__InfluenzaA__ADI24517

SEQ ID NO: 66018 - RNA, 1701 nt, Artificial Sequence; identical to SEQ ID NO: 64841
  derived and/or modified sequence opt1 from hemagglutinin__InfluenzaA__ADI24519

SEQ ID NO: 66019 - RNA, 1701 nt, Artificial Sequence; identical to SEQ ID NO: 64841
  derived and/or modified sequence opt1 from hemagglutinin__InfluenzaA__ADI24521

SEQ ID NO: 66020 - RNA, 1701 nt, Artificial Sequence; identical to SEQ ID NO: 65229
  derived and/or modified sequence opt1 from hemagglutinin__InfluenzaA__ADI24523

SEQ ID NO: 66021 - RNA, 1701 nt, Artificial Sequence
  derived and/or modified sequence opt1 from hemagglutinin__InfluenzaA__ADI24525
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcgagcugcgcggcgucgcgccccugcaccucgggaagugcaacaucgccggcuggauccuggggaacccggagugcgagagccuguccaccgcgcggagcugguccuacaucguggagaccagcuccagcgacaacggcacgugcuaccccggcgacuucaucgacuacgaggagcuccgcgagcagcuguccagcguguccagcuucgagcgguucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66022 - RNA, 1701 nt, Artificial Sequence; identical to SEQ ID NO: 64841
  derived and/or modified sequence opt1 from hemagglutinin__InfluenzaA__ADI24527

SEQ ID NO: 66023 - RNA, 1701 nt, Artificial Sequence; identical to SEQ ID NO: 65229
  derived and/or modified sequence opt1 from hemagglutinin__InfluenzaA__ADI24529

SEQ ID NO: 66024 - RNA, 1701 nt, Artificial Sequence
  derived and/or modified sequence opt1 from hemagglutinin__InfluenzaA__ADI24531
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcugcucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugcaagaucugcaucuga

SEQ ID NO: 66025 - RNA, 1701 nt, Artificial Sequence
  derived and/or modified sequence opt1 from hemagglutinin__InfluenzaA__ADI24536
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66026 - RNA, 1701 nt, Artificial Sequence; identical to SEQ ID NO: 64841
  derived and/or modified sequence opt1 from hemagglutinin__InfluenzaA__ADI24546

SEQ ID NO: 66027 - RNA, 1701 nt, Artificial Sequence; identical to SEQ ID NO: 64841
  derived and/or modified sequence opt1 from hemagglutinin__InfluenzaA__ADI24553

SEQ ID NO: 66028 - RNA, 1701 nt, Artificial Sequence; identical to SEQ ID NO: 64841
  derived and/or modified sequence opt1 from hemagglutinin__InfluenzaA__ADI24555

SEQ ID NO: 66029 - RNA, 1701 nt, Artificial Sequence
  derived and/or modified sequence opt1 from hemagglutinin__InfluenzaA__ADI24557
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggagauccuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66030 - RNA, 1701 nt, Artificial Sequence; identical to SEQ ID NO: 64841
  derived and/or modified sequence opt1 from hemagglutinin__InfluenzaA__ADI24559

SEQ ID NO: 66031 - RNA, 1701 nt, Artificial Sequence
  derived and/or modified sequence opt1 from hemagglutinin__InfluenzaA__ADI24561
augaaggccauccuggugauccuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacgacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66032 - RNA, 1701 nt, Artificial Sequence; identical to SEQ ID NO: 64841
  derived and/or modified sequence opt1 from hemagglutinin__InfluenzaA__ADI24563

SEQ ID NO: 66033 - RNA, 1701 nt, Artificial Sequence
  derived and/or modified sequence opt1 from hemagglutinin__InfluenzaA__ADI24565
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaagaaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66034 - RNA, 1701 nt, Artificial Sequence; identical to SEQ ID NO: 64841
  derived and/or modified sequence opt1 from hemagglutinin__InfluenzaA__ADI24567

SEQ ID NO: 66035 - RNA, 1701 nt, Artificial Sequence
  derived and/or modified sequence opt1 from hemagglutinin__InfluenzaA__ADI24569
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccaucgagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66036 - RNA, 1701 nt, Artificial Sequence; identical to SEQ ID NO: 64841
  derived and/or modified sequence opt1 from hemagglutinin__InfluenzaA__ADI24571

SEQ ID NO: 66037 - RNA, 1701 nt, Artificial Sequence; identical to SEQ ID NO: 65229
  derived and/or modified sequence opt1 from hemagglutinin__InfluenzaA__ADI24573

SEQ ID NO: 66038 - RNA, 1701 nt, Artificial Sequence
  derived and/or modified sequence opt1 from hemagglutinin__InfluenzaA__ADI24575
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacguggagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66039 - RNA, 1701 nt, Artificial Sequence; identical to SEQ ID NO: 64841
  derived and/or modified sequence opt1 from hemagglutinin__InfluenzaA__ADI24577

SEQ ID NO: 66040 - RNA, 1701 nt, Artificial Sequence
  derived and/or modified sequence opt1 from hemagglutinin__InfluenzaA__ADI24581
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcugggugcuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66041 - RNA, 1701 nt, Artificial Sequence
  derived and/or modified sequence opt1 from hemagglutinin__InfluenzaA__ADI24583
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66042 - RNA, 1701 nt, Artificial Sequence
  derived and/or modified sequence opt1 from hemagglutinin__InfluenzaA__ADI24590
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 66043 - RNA, 1701 nt, Artificial Sequence
  derived and/or modified sequence opt1 from hemagglutinin__InfluenzaA__ADI24597
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaacugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 66044 - RNA, 1701 nt, Artificial Sequence; identical to SEQ ID NO: 66042
  derived and/or modified sequence opt1 from hemagglutinin__InfluenzaA__ADI24612

SEQ ID NO: 66045 - RNA, 1701 nt, Artificial Sequence
  derived and/or modified sequence opt1 from hemagglutinin__InfluenzaA__ADI24619
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgucgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66046 - RNA, 1701 nt, Artificial Sequence
  derived and/or modified sequence opt1 from hemagglutinin__InfluenzaA__ADI24621
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcaccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucaucgugucccugggggccaucagcuucuggaugugcuccaacggcagccugcagugccggaucugcaucuga

SEQ ID NO: 66047 - RNA, 1701 nt, Artificial Sequence
  derived and/or modified sequence opt1 from hemagglutinin__InfluenzaA__ADI48184
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggggcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagcgcguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 66048 - RNA, 1701 nt, Artificial Sequence; identical to SEQ ID NO: 64841
  derived and/or modified sequence opt1 from hemagglutinin__InfluenzaA__ADI48186

SEQ ID NO: 66049 - RNA, 1701 nt, Artificial Sequence
  derived and/or modified sequence opt1 from hemagglutinin__InfluenzaA__ADI48188
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccgacaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 66050 - RNA, 1701 nt, Artificial Sequence
  derived and/or modified sequence opt1 from hemagglutinin__InfluenzaA__ADI48190
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcaccaagaucuaccagauccuggcgaucuacuccaccgucgccagcagccuggugcucguggucucccugggggccaucagcuucuggaugugcuccaacggcagccugcagugccgcaucugcaucuga

SEQ ID NO: 66051 - RNA, 1701 nt, Artificial Sequence
  derived and/or modified sequence opt1 from hemagglutinin__InfluenzaA__ADI48192
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccugaccaucuacuccaccgucgcgagcagccuggugcucguggucucccugggggccaucagcuucuggaugugcuccaacggcagccugcagugccggaucugcaucuga

SEQ ID NO: 66052 - RNA, 1701 nt, Artificial Sequence
  derived and/or modified sequence opt1 from hemagglutinin__InfluenzaA__ADI48194
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagccugguguccagcuucgagcgcuucgagaucuuccccaagaccaacuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccuccaccagcgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcucccucgugcugguggucagccugggggccaucagcuucuggaugugcuccaacggcagccuccagugccggaucugcaucuga

SEQ ID NO: 66053 - RNA, 1701 nt, Artificial Sequence
  derived and/or modified sequence opt1 from hemagglutinin__InfluenzaA__ADI48196
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgacagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66054 - RNA, 1701 nt, Artificial Sequence; identical to SEQ ID NO: 64841
  derived and/or modified sequence opt1 from hemagglutinin__InfluenzaA__ADI48198

SEQ ID NO: 66055 - RNA, 1701 nt, Artificial Sequence; identical to SEQ ID NO: 64841
  derived and/or modified sequence opt1 from hemagglutinin__InfluenzaA__ADI48200

SEQ ID NO: 66056 - RNA, 1701 nt, Artificial Sequence
  derived and/or modified sequence opt1 from hemagglutinin__InfluenzaA__ADI48202
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaucagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66057 - RNA, 1701 nt, Artificial Sequence
  derived and/or modified sequence opt1 from hemagglutinin__InfluenzaA__ADI48204
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacguggacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaagaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 66058 - RNA, 1701 nt, Artificial Sequence; identical to SEQ ID NO: 64841
  derived and/or modified sequence opt1 from hemagglutinin__InfluenzaA__ADI48208

SEQ ID NO: 66059 - RNA, 1701 nt, Artificial Sequence; identical to SEQ ID NO: 64841
  derived and/or modified sequence opt1 from hemagglutinin__InfluenzaA__ADI48210

SEQ ID NO: 66060 - RNA, 1701 nt, Artificial Sequence
  derived and/or modified sequence opt1 from hemagglutinin__InfluenzaA__ADI48212
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacguguggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66061 - RNA, 1701 nt, Artificial Sequence
  derived and/or modified sequence opt1 from hemagglutinin__InfluenzaA__ADI48214
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucgccgugucccugggggccaucagcuucuggaugugcuccaacggcagccugcagugccggaucugcaucuga

SEQ ID NO: 66062 - RNA, 1701 nt, Artificial Sequence; identical to SEQ ID NO: 66060
  derived and/or modified sequence opt1 from hemagglutinin__InfluenzaA__ADI48216

SEQ ID NO: 66063 - RNA, 1701 nt, Artificial Sequence
  derived and/or modified sequence opt1 from hemagglutinin__InfluenzaA__ADI48218
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccaggacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66064 - RNA, 1701 nt, Artificial Sequence
  derived and/or modified sequence opt1 from hemagglutinin__InfluenzaA__ADI48220
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgagaccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccugggguaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 66065 - RNA, 1701 nt, Artificial Sequence
  derived and/or modified sequence opt1 from hemagglutinin__InfluenzaA__ADI48622
augaaggccauccugguguuccuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66066 - RNA, 1701 nt, Artificial Sequence
  derived and/or modified sequence opt1 from hemagglutinin__InfluenzaA__ADI48632
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucuggggcgugcaccaccccagcaccuccgccgaccagcagagccuguaccagaacgccgacgccuacguguucgucggguccagccgguacuccaagaaguucaagcccgagaucgccauccgcccgaaggugcgggaccaggagggccgcaugaacuacuacuggacgcugguggagcccggggacaagaucaccuucgaggcgaccggcaaccucgucgugccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgucaaguccaccaagcugcggcucgcgaccggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 66067 - RNA, 1701 nt, Artificial Sequence; identical to SEQ ID NO: 63919
  derived and/or modified sequence opt1 from hemagglutinin__InfluenzaA__ADI48642

SEQ ID NO: 66068 - RNA, 1701 nt, Artificial Sequence; identical to SEQ ID NO: 63919
  derived and/or modified sequence opt1 from hemagglutinin__InfluenzaA__ADI48652

SEQ ID NO: 66069 - RNA, 1701 nt, Artificial Sequence
  derived and/or modified sequence opt1 from hemagglutinin__InfluenzaA__ADI48672
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaacaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 66070 - RNA, 1701 nt, Artificial Sequence; identical to SEQ ID NO: 63677
  derived and/or modified sequence opt1 from hemagglutinin__InfluenzaA__ADI48682

SEQ ID NO: 66071 - RNA, 1701 nt, Artificial Sequence; identical to SEQ ID NO: 63919
  derived and/or modified sequence opt1 from hemagglutinin__InfluenzaA__ADI48692

SEQ ID NO: 66072 - RNA, 1701 nt, Artificial Sequence; identical to SEQ ID NO: 63857
  derived and/or modified sequence opt1 from hemagglutinin__InfluenzaA__ADI48702

SEQ ID NO: 66073 - RNA, 1701 nt, Artificial Sequence; identical to SEQ ID NO: 63919
  derived and/or modified sequence opt1 from hemagglutinin__InfluenzaA__ADI48712

SEQ ID NO: 66074 - RNA, 1701 nt, Artificial Sequence; identical to SEQ ID NO: 63919
  derived and/or modified sequence opt1 from hemagglutinin__InfluenzaA__ADI48722

SEQ ID NO: 66075 - RNA, 1701 nt, Artificial Sequence; identical to SEQ ID NO: 63677
  derived and/or modified sequence opt1 from hemagglutinin__InfluenzaA__ADI48732

SEQ ID NO: 66076 - RNA, 1701 nt, Artificial Sequence; identical to SEQ ID NO: 63677
  derived and/or modified sequence opt1 from hemagglutinin__InfluenzaA__ADI48742

SEQ ID NO: 66077 - RNA, 1701 nt, Artificial Sequence
  derived and/or modified sequence opt1 from hemagglutinin__InfluenzaA__ADI48752
auggaggccauccugguguuccuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcuccagccgguacuccaagaaguucaagcccgagaucgccauccgcccgaaggugcgggaccaggagggccgcaugaacuacuacuggacgcugguggagcccggggacaagaucaccuucgaggcgaccggcaaccucgucgugccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgucaaguccaccaagcugcggcucgcgaccggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacagcgugaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 66078 - RNA, 1701 nt, Artificial Sequence; identical to SEQ ID NO: 63919
  derived and/or modified sequence opt1 from hemagglutinin__InfluenzaA__ADI48762

SEQ ID NO: 66079 - RNA, 1701 nt, Artificial Sequence
  derived and/or modified sequence opt1 from hemagglutinin__InfluenzaA__ADI48772
auggaggccauccuggugguccuccuguacaccuucgccaccgcgaacgccgacacgcugugcaucggcuaccaggccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 66080 - RNA, 1701 nt, Artificial Sequence
  derived and/or modified sequence opt1 from hemagglutinin__InfluenzaA__ADI48782
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggagagcaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 66081 - RNA, 1701 nt, Artificial Sequence
  derived and/or modified sequence opt1 from hemagglutinin__InfluenzaA__ADI48792
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacaucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 66082 - RNA, 1701 nt, Artificial Sequence
  derived and/or modified sequence opt1 from hemagglutinin__InfluenzaA__ADI49029
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagagcaccaagcugcggcucgcgaccggccugaagaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66083 - RNA, 1701 nt, Artificial Sequence; identical to SEQ ID NO: 63919
  derived and/or modified sequence opt1 from hemagglutinin__InfluenzaA__ADI49240

SEQ ID NO: 66084 - RNA, 1701 nt, Artificial Sequence; identical to SEQ ID NO: 63919
  derived and/or modified sequence opt1 from hemagglutinin__InfluenzaA__ADI49260

SEQ ID NO: 66085 - RNA, 1701 nt, Artificial Sequence
  derived and/or modified sequence opt1 from hemagglutinin__InfluenzaA__ADI49270
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgcccgggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66086 - RNA, 1701 nt, Artificial Sequence; identical to SEQ ID NO: 63919
  derived and/or modified sequence opt1 from hemagglutinin__InfluenzaA__ADI49280

SEQ ID NO: 66087 - RNA, 1701 nt, Artificial Sequence; identical to SEQ ID NO: 63919
  derived and/or modified sequence opt1 from hemagglutinin__InfluenzaA__ADI49312

SEQ ID NO: 66088 - RNA, 1701 nt, Artificial Sequence; identical to SEQ ID NO: 63919
  derived and/or modified sequence opt1 from hemagglutinin__InfluenzaA__ADI49322

SEQ ID NO: 66089 - RNA, 1701 nt, Artificial Sequence; identical to SEQ ID NO: 63919
  derived and/or modified sequence opt1 from hemagglutinin__InfluenzaA__ADI49332

SEQ ID NO: 66090 - RNA, 1701 nt, Artificial Sequence; identical to SEQ ID NO: 64246
  derived and/or modified sequence opt1 from hemagglutinin__InfluenzaA__ADI49342

SEQ ID NO: 66091 - RNA, 1701 nt, Artificial Sequence; identical to SEQ ID NO: 63919
  derived and/or modified sequence opt1 from hemagglutinin__InfluenzaA__ADI49352

SEQ ID NO: 66092 - RNA, 1701 nt, Artificial Sequence; identical to SEQ ID NO: 63677
  derived and/or modified sequence opt1 from hemagglutinin__InfluenzaA__ADI49362

SEQ ID NO: 66093 - RNA, 1701 nt, Artificial Sequence; identical to SEQ ID NO: 65229
  derived and/or modified sequence opt1 from hemagglutinin__InfluenzaA__ADI49382

SEQ ID NO: 66094 - RNA, 1701 nt, Artificial Sequence; identical to SEQ ID NO: 64030
  derived and/or modified sequence opt1 from hemagglutinin__InfluenzaA__ADI49392

SEQ ID NO: 66095 - RNA, 1701 nt, Artificial Sequence; identical to SEQ ID NO: 63664
  derived and/or modified sequence opt1 from hemagglutinin__InfluenzaA__ADI49717

SEQ ID NO: 66096 - RNA, 1701 nt, Artificial Sequence
  derived and/or modified sequence opt1 from hemagglutinin__InfluenzaA__ADI49727
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcaucaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 66097 - RNA, 1701 nt, Artificial Sequence; identical to SEQ ID NO: 63664
  derived and/or modified sequence opt1 from hemagglutinin__InfluenzaA__ADI49737

SEQ ID NO: 66098 - RNA, 1701 nt, Artificial Sequence; identical to SEQ ID NO: 63664
  derived and/or modified sequence opt1 from hemagglutinin__InfluenzaA__ADI49747

SEQ ID NO: 66099 - RNA, 1701 nt, Artificial Sequence; identical to SEQ ID NO: 63664
  derived and/or modified sequence opt1 from hemagglutinin__InfluenzaA__ADI49757

SEQ ID NO: 66100 - RNA, 1701 nt, Artificial Sequence; identical to SEQ ID NO: 63664
  derived and/or modified sequence opt1 from hemagglutinin__InfluenzaA__ADI49767

SEQ ID NO: 66101 - RNA, 1701 nt, Artificial Sequence
  derived and/or modified sequence opt1 from hemagglutinin__InfluenzaA__ADI49777
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccacggaccagcagagccucuaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcaacggcucccugcagugccggaucugcaucuga

SEQ ID NO: 66102 - RNA, 1701 nt, Artificial Sequence
  derived and/or modified sequence opt1 from hemagglutinin__InfluenzaA__ADI49787
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcaucuccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 66103 - RNA, 1701 nt, Artificial Sequence; identical to SEQ ID NO: 65012
  derived and/or modified sequence opt1 from hemagglutinin__InfluenzaA__ADI49822

SEQ ID NO: 66104 - RNA, 1701 nt, Artificial Sequence
  derived and/or modified sequence opt1 from hemagglutinin__InfluenzaA__ADI50027
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaaguacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacgggcaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcaucaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 66105 - RNA, 1701 nt, Artificial Sequence
  derived and/or modified sequence opt1 from hemagglutinin__InfluenzaA__ADI52834
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccacccgcccaccagcgccgaccagcagucccucuaccagaacgccgacgccuacguguucgugggcagcucccgguacagcaagaaguucaagcccgagaucgccauccgccccaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucagcgacaccccggugcacgacugcaacacgaccugccagacccccaagggcgccaucaacaccucccuccccuuccagaacauccaccccaucacgaucgggaagugcccgaaguacgucaagagcaccaagcugcggcuggcgaccggccuccgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagguggggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccgccgccagcagccuggugcugguggucucccucggggccaucagcuucuggaugugcuccaacggcagccugcagugccggaucugcaucuga

SEQ ID NO: 66106 - RNA, 1701 nt, Artificial Sequence
  derived and/or modified sequence opt1 from hemagglutinin__InfluenzaA__ADI52835
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccacccgcccaccagcgccgaccagcagucccuguaccagaacgccgacgccuacguguucgugggcagcuccaaguacagcaagaaguucaagcccgagaucgccauccggcccaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucagcgacaccccggugcacgacugcaacacgaccugccagacccccaagggcgccaucaacaccucccugcccuuccacaacauccaccccaucacgaucgggaagugcccgaaguacgucaagagcaccaagcugcgccucgcgaccggccugcggaacgugcccuccauccagagccgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcaccaagaucuaccagauccuggcgaucuacuccaccgucgccagcagccuggugcucguggucucccugggggccaucagcuucuggaugugcuccaacggcagccugcagugccggaucugcaucuga

SEQ ID NO: 66107 - RNA, 1701 nt, Artificial Sequence
  derived and/or modified sequence opt1 from hemagglutinin__InfluenzaA__ADI52836
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccuccgccgaccagcagcggcuguaccagaacgccgacgccuacguguucguggggagcuccaaguacagcaagaaguucaagcccgagaucgccauccgcccgaagguccgggaccaggagggccgcaugaacuacuacuggacgcugguggagcccggcgacaagaucaccuucgaggcgaccgggaaccucguggucccccgguacgccuucgccauggagcgcaacgccggcuccgggaucaucaucagcgacacccccgugcacgacugcaacacgaccugccagaccccgaagggcgccaucaacaccucccugcccuuccacaacauccaccccaucacgaucggcaagugccccaaguacgucaagagcaccaagcugcggcucgcgaccgggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacgcagaacgcgaucgacgagaucaccaacaaggugaacuccgucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcaccaagaucuaccagauccuggcgaucuacuccaccgucgccagcagccuggugcucguggucucccugggcgccaucagcuucuggaugugcuccaacgggagccugcagugccgcaucugcaucuga

SEQ ID NO: 66108 - RNA, 1701 nt, Artificial Sequence
  derived and/or modified sequence opt1 from hemagglutinin__InfluenzaA__ADI52837
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggucaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcuccagcaaguacuccaagaaguucaagcccgagaucgccauccggccgaaggugcgcgaccaggagggccggaugaacuacuacuggacgcugguggagcccggggacaagaucaccuucgaggcgaacggcaaccucgucgugccccgcuacgccuucgccauggagcggaacgccgggagcggcaucaucaucuccgacacccccgugcacgacugcaacaccacgugccagaccccgaagggcgccaucaacaccagccugcccuuccacaacauccaccccaucaccaucgggaagugccccaaguacgucaaguccacgaagcugcgccucgcgaccggccugcggaacgugccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucacgaacaaggucaacagcgugaucgagaagaugaacacccaguucaccgccgucggcaaggaguucaaccaccuggagaagcggaucgagaaccugaacaagaagguggacgacggcuuccucgacaucuggaccuacaacgccgagcugcuggugcuccuggagaacgagcgcacgcuggacuaccacgacuccaacgucaagaaccucuacgagaaggugcggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgucaagcucgaguccaccaagaucuaccagauccuggcgaucuacagcaccguggccagcucccuggugcucgucgugagccugggggccaucuccuucuggaugugcagcaacggcucccugcagugccggaucugcaucuga

SEQ ID NO: 66109 - RNA, 1701 nt, Artificial Sequence; identical to SEQ ID NO: 64475
  derived and/or modified sequence opt1 from hemagglutinin__InfluenzaA__ADI72915

SEQ ID NO: 66110 - RNA, 1701 nt, Artificial Sequence; identical to SEQ ID NO: 64475
  derived and/or modified sequence opt1 from hemagglutinin__InfluenzaA__ADI72916

SEQ ID NO: 66111 - RNA, 1701 nt, Artificial Sequence; identical to SEQ ID NO: 64475
  derived and/or modified sequence opt1 from hemagglutinin__InfluenzaA__ADI72917

SEQ ID NO: 66112 - RNA, 1701 nt, Artificial Sequence
  derived and/or modified sequence opt1 from hemagglutinin__InfluenzaA__ADI72918
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgaccggggcaaggaggugcugguccucugggggauccaccaccccagcaccagcgccgaccagcagucccuguaccagaacgccgacgccuacguguucgugggcacgagccgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaagcucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 66113 - RNA, 1701 nt, Artificial Sequence; identical to SEQ ID NO: 64475
  derived and/or modified sequence opt1 from hemagglutinin__InfluenzaA__ADI72919

SEQ ID NO: 66114 - RNA, 1701 nt, Artificial Sequence; identical to SEQ ID NO: 64475
  derived and/or modified sequence opt1 from hemagglutinin__InfluenzaA__ADI72920

SEQ ID NO: 66115 - RNA, 1701 nt, Artificial Sequence
  derived and/or modified sequence opt1 from hemagglutinin__InfluenzaA__ADI72921
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgcuggacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 66116 - RNA, 1701 nt, Artificial Sequence; identical to SEQ ID NO: 63677
  derived and/or modified sequence opt1 from hemagglutinin__InfluenzaA__ADI72922

SEQ ID NO: 66117 - RNA, 1701 nt, Artificial Sequence
  derived and/or modified sequence opt1 from hemagglutinin__InfluenzaA__ADI72923
augaaggccauccuggugguccuccuguacaccuucgccaccagcaacgcggacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacccgaacaagggggucaccgccgccugcccccacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagccggagaucgccauccgccccaagguccgggaccaggagggccgcaugaacuacuacuggacccugguggagcccggggacaagaucaccuucgaggccaccggcaaccucguggucccccgguacgcguucgccauggagcgcaacgccgggccgggcaucaucaucuccgacacgcccgugcacgacugcaacacgaccugccagacccccaagggcgccaucaacaccagccugcccuuccagaacauccacccgaucaccaucgggaagugccccaaguacgugaaguccaccaagcugcggcucgccaccggccugcgcaacguccccagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 66118 - RNA, 1701 nt, Artificial Sequence; identical to SEQ ID NO: 64475
  derived and/or modified sequence opt1 from hemagglutinin__InfluenzaA__ADI72924

SEQ ID NO: 66119 - RNA, 1701 nt, Artificial Sequence; identical to SEQ ID NO: 63677
  derived and/or modified sequence opt1 from hemagglutinin__InfluenzaA__ADI72925

SEQ ID NO: 66120 - RNA, 1701 nt, Artificial Sequence
  derived and/or modified sequence opt1 from hemagglutinin__InfluenzaA__ADI72926
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcggcuacuccaagaaguucaagccggagaucgccauccggcccaagguccgcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccgacacgccggugcacgacugcaacacgaccugccagacccccaagggggccaucaacaccagccugcccuuccagaacauccaccccaucaccaucggcaagugcccgaaguacgugaaguccaccaagcugcgccucgcgaccgggcugcggaacguccccagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccuccagccuggugcucguggucagccugggcgccaucuccuucuggaugugcagcaacggcucccugcagugccgcaucugcaucuga

SEQ ID NO: 66121 - RNA, 1701 nt, Artificial Sequence
  derived and/or modified sequence opt1 from hemagglutinin__InfluenzaA__ADI72927
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucacguccgacaccccggugcacgacugcaacacgaccugccagacccccaagggcgccaucaacaccagccugcccuuccagaacauccaccccaucaccaucgggaagugcccgaaguacgugaaguccaccaagcugcggcucgcgacgggccugcgcaacguccccagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66122 - RNA, 1701 nt, Artificial Sequence
  derived and/or modified sequence opt1 from hemagglutinin__InfluenzaA__ADI72928
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgcgagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggugaccgccgccugcccccacgccggcgccaagagcuucuacaagaaccugaucuggcucgucaagaaggggaacuccuaccccaagcugagcaaguccuacaucaacgacaagggcaaggaggugcuggugcucugggggauccaccaccccagcaccagcgccgaccagcagucccuguaccagaacgccgacgccuacgucuucgugggcacgagccgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccggaaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 66123 - RNA, 1701 nt, Artificial Sequence; identical to SEQ ID NO: 63677
  derived and/or modified sequence opt1 from hemagglutinin__InfluenzaA__ADI72929

SEQ ID NO: 66124 - RNA, 1701 nt, Artificial Sequence; identical to SEQ ID NO: 63677
  derived and/or modified sequence opt1 from hemagglutinin__InfluenzaA__ADI72930

SEQ ID NO: 66125 - RNA, 1701 nt, Artificial Sequence
  derived and/or modified sequence opt1 from hemagglutinin__InfluenzaA__ADI72931
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcaucaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 66126 - RNA, 1701 nt, Artificial Sequence; identical to SEQ ID NO: 65333
  derived and/or modified sequence opt1 from hemagglutinin__InfluenzaA__ADI72932

SEQ ID NO: 66127 - RNA, 1698 nt, Artificial Sequence
  derived and/or modified sequence opt1 from hemagglutinin__InfluenzaA__ADI75818
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuacaagaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccagggcgcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggcuucaucgacaucuggacguacaacgccgagcugcuggugcuccuggagaacgagcgcacccuggacuuccacgacagcaacgugaagaaccucuacgagaaggucaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggggucuaccagauccuggcgaucuacagcaccguggccuccagccuggugcuccuggucucccugggcgccaucagcuucuggaugugcuccaacggcagccuccagugccgcaucugcaucuga

SEQ ID NO: 66128 - RNA, 1698 nt, Artificial Sequence
  derived and/or modified sequence opt1 from hemagglutinin__InfluenzaA__ADI75851
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggagcuacaucguggagaagcccaaccccgagaacgggaccugcuaccccgggcacuucgccgacuacgaggagcugcgcgagcagcucuccagcguguccagcuucgagcgguucgagaucuucccgaaggaguccagcuggcccaaccacacggucaccggcguguccgccagcugcucccacaacggggagagcuccuucuaccgcaaccugcuguggcucaccggcaagaacgggcuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggggacaccaucaucuucgaggccaacggcaaccugaucgcgccgcgcuacgccuucgcccucucccggggguucggcagcggcaucaucaacuccaacgcccccauggggaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggcgucaagcucgaguccauggggguguaccagauccuggcgaucuacagcaccguggccagcucccugguccuccuggugagccugggcgccaucuccuucuggaugugcagcaacgggucccuccagugccgcaucugcaucuga

SEQ ID NO: 66129 - RNA, 1701 nt, Artificial Sequence; identical to SEQ ID NO: 63442
  derived and/or modified sequence opt1 from hemagglutinin__InfluenzaA__ADI75884

SEQ ID NO: 66130 - RNA, 1701 nt, Artificial Sequence; identical to SEQ ID NO: 63442
  derived and/or modified sequence opt1 from hemagglutinin__InfluenzaA__ADI75917

SEQ ID NO: 66131 - RNA, 1698 nt, Artificial Sequence
  derived and/or modified sequence opt1 from hemagglutinin__InfluenzaA__ADI77349
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucauccuguggggcguccaccacccgcccaacauggccgaccagaagacccuguaccacacggagaacgccuacguguccguggucagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacacgaagugccagacgccccagggcgcgaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgccggguucaucgagggcggcuggaccgggauggucgacggcugguacggguaccaccaccagaacgagcagggcagcggguacgccgcggaccagaaguccacccagaacgccaucaacggcaucaccaacaaggugaacagcgugaucgagaagaugaacacccaguucacggccgucggcaaggaguucaacaagcuggagcggcgcauggagaaccucaacaagaagguggacgacggguucaucgacaucuggaccuacaacgccgagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggcgaucuacuccacggucgccagcagccuggugcuccuggugucccugggcgccaucagcuucuggaugugcuccaacgggagccuccagugccggaucugcaucuga

SEQ ID NO: 66132 - RNA, 1701 nt, Artificial Sequence; identical to SEQ ID NO: 63677
  derived and/or modified sequence opt1 from hemagglutinin__InfluenzaA__ADI77360

SEQ ID NO: 66133 - RNA, 1701 nt, Artificial Sequence
  derived and/or modified sequence opt1 from hemagglutinin__InfluenzaA__ADI99498
augaagaccauccuggugguccuccuguacaccuucgccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcugaacaaguccuacaucaacgacaagggcaaggaggugcugguccucugggggauccaccaccccagcacgagcgcggaccagcagucccuguaccagaacgccgacgccuacguguucgugggcaccagccgguacuccaagaaguucaagcccgagaucgccauccgcccgaagguccggggccaggaggggcgcaugaacuacuacuggacccuggugaagcccggcgacaagaucaccuucgaggccacggggaaccucguggucccccgguacgcguucgccauggagcgcaacgccggcagcggcaucaucaucuccgacacccccgugcacgacugcaacacgaccugccagaccccgaagggggccaucaacaccagccugcccuuccagaacauccaccccaucaccaucggcaagugccccaaguacgugaaguccaccaagcugcggcucgccacggggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucagccugggcgccaucuccuucuggaugugcagcaacggcucccugcagugccggaucugcaucuga

SEQ ID NO: 66134 - RNA, 1701 nt, Artificial Sequence
  derived and/or modified sequence opt1 from hemagglutinin__InfluenzaA__ADI99560
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcaacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66135 - RNA, 1701 nt, Artificial Sequence; identical to SEQ ID NO: 66134
  derived and/or modified sequence opt1 from hemagglutinin__InfluenzaA__ADI99570

SEQ ID NO: 66136 - RNA, 1701 nt, Artificial Sequence; identical to SEQ ID NO: 66134
  derived and/or modified sequence opt1 from hemagglutinin__InfluenzaA__ADI99580

SEQ ID NO: 66137 - RNA, 1701 nt, Artificial Sequence; identical to SEQ ID NO: 65290
  derived and/or modified sequence opt1 from hemagglutinin__InfluenzaA__ADI99590

SEQ ID NO: 66138 - RNA, 1701 nt, Artificial Sequence
  derived and/or modified sequence opt1 from hemagglutinin__InfluenzaA__ADI99610
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggagauccuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66139 - RNA, 1701 nt, Artificial Sequence
  derived and/or modified sequence opt1 from hemagglutinin__InfluenzaA__ADI99620
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucacggacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66140 - RNA, 1701 nt, Artificial Sequence
  derived and/or modified sequence opt1 from hemagglutinin__InfluenzaA__ADI99630
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagaacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66141 - RNA, 1701 nt, Artificial Sequence
  derived and/or modified sequence opt1 from hemagglutinin__InfluenzaA__ADI99640
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacuccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgccuucgcgauggagcgcaacgccgggagcggcaucaucaucuccgacacccccauccacgacugcaacacgaccugccagaccccggagggcgccaucaacaccagccugcccuuccagaacauccaccccaucaccaucgggaagugccccaaguacgugaaguccaccaagcugcggcucgccacgggccugcgcaacgugccgagcauccagucccgggggcuguucggcgccaucgcgggguucaucgagggcggcuggaccgggauggucgacggcugguacggguaccaccaccagaacgagcagggcagcggguacgccgccgaccucaaguccacccagaacgccaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgcggagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggccagcucccugguccucguggugagccugggggcgaucuccuucuggaugugcagcaacggcucccugcagugccggaucugcaucuga

SEQ ID NO: 66142 - RNA, 1701 nt, Artificial Sequence; identical to SEQ ID NO: 65229
  derived and/or modified sequence opt1 from hemagglutinin__InfluenzaA__ADI99660

SEQ ID NO: 66143 - RNA, 1701 nt, Artificial Sequence
  derived and/or modified sequence opt1 from hemagglutinin__InfluenzaA__ADI99670
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacggcuaccccaaguacuccgaggaggccaagcugaaccgggaggagaucgacggggugaagcuggagagcacccgcaucuaccagauccucgcgaucuacuccaccgucgccagcagccuggugcugguggucucccucggcgccaucagcuucuggaugugcuccaacggcagccugcagugccggaucugcaucuga

SEQ ID NO: 66144 - RNA, 1701 nt, Artificial Sequence
  derived and/or modified sequence opt1 from hemagglutinin__InfluenzaA__ADI99680
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggaccaucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 66145 - RNA, 1701 nt, Artificial Sequence
  derived and/or modified sequence opt1 from hemagglutinin__InfluenzaA__ADI99690
augaaggccauccuggccgugcuccuguacaccuucgcgaucgccaacgccgacacccugugcaucggcuaccacgccaacaacagcacggacaccgucgacaccgugcucgagaagaacgugaccgucacgcacuccgugaacauccuggaggacaagcacaacgggaagcugugcaagcuccgcggcguggcgccccugcaccuggggaagugcaacaucgccggcuggauccucgggaacccggagugcgagagccuguccaccgccagcuccuggagcuacaucgucgagaccuccagcuccgacaacgggaccugcuaccccggcgacuucaucgacuacgaggagcugcgggagcagcucagcuccgugagcuccuucgagcgcuucgagaucuuccccaagacgagcuccuggcccaaccacgacagcaacaagggcgugaccgccgccugcccgcacgcgggcgccaaguccuucuacaagaaccugaucuggcuggucaagaaggggaacagcuaccccaagcucuccaagagcuacaucaacgacaagggcaagaaggugcuggugcugugggggauccaccaccccagcaccuccgccgaccagcagagccucuaccagaacgccgacgccuacgucuucgugggcaccucccgguacagcaagaaguucaagcccgagaucgcgauccgcccgaaggugcgggaccaggagggccgcaugaacuacuacuggacgcuggucgagcccggggacaagaucaccuucgaggccaccggcaaccugguggugccccgguacgccuucgccauggagcgcaacgccggguccggcaucaucaucagcgacacccccguccacgacugcaacacgaccugccagaccccgaagggcgcgaucaacaccucccuccccuuccagaacauccaccccaucacgaucgggaagugccccaaguacgucaagagcaccaagcugcggcuggccaccggccuccgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccuggacaucuggacguacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcuggagagcacccgcaucuaccagauccucgccaucuacuccaccguggccagcagccugguccugguggugucccucggggccaucagcuucuggaugugcuccaacggcagccugcagugccggaucugcaucuga

SEQ ID NO: 66146 - RNA, 1701 nt, Artificial Sequence
  derived and/or modified sequence opt1 from hemagglutinin__InfluenzaA__ADI99700
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucagcccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgcggccugcccgcacgccggcgccaagagcuucuacaagaaccugaucuggcucgugaagaaggggaacuccuaccccaagcugagcaagagcuacaucaacgacaagggcaaggaggugcugguccucuggggcgugcaccaccccuccaccagcgcggaccagcagucccuguaccagaacgccgacgccuacguguucgucgggacgagccgguacuccaagaaguucaagcccgagaucgccauccgcccgaaggugcgggaccaggagggccgcaugaacuacuacuggacccugguggagcccggggacaagaucaccuucgaggccaccggcaaccucgucgcgccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 66147 - RNA, 1701 nt, Artificial Sequence; identical to SEQ ID NO: 65326
  derived and/or modified sequence opt1 from hemagglutinin__InfluenzaA__ADI99710

SEQ ID NO: 66148 - RNA, 1701 nt, Artificial Sequence
  derived and/or modified sequence opt1 from hemagglutinin__InfluenzaA__ADI99720
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucucccgguacgccuucgccauggagcgcaacgccggcagcggcaucaucaucuccgacacgcccgugcacgacugcaacacgaccugccagacccccaagggggccaucaacaccagccugccguuccagaacauccaccccaucaccaucggcaagugccccaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 66149 - RNA, 1701 nt, Artificial Sequence; identical to SEQ ID NO: 63677
  derived and/or modified sequence opt1 from hemagglutinin__InfluenzaA__ADI99730

SEQ ID NO: 66150 - RNA, 1701 nt, Artificial Sequence; identical to SEQ ID NO: 63677
  derived and/or modified sequence opt1 from hemagglutinin__InfluenzaA__ADJ00497

SEQ ID NO: 66151 - RNA, 1701 nt, Artificial Sequence; identical to SEQ ID NO: 63677
  derived and/or modified sequence opt1 from hemagglutinin__InfluenzaA__ADJ00498

SEQ ID NO: 66152 - RNA, 1701 nt, Artificial Sequence; identical to SEQ ID NO: 64871
  derived and/or modified sequence opt1 from hemagglutinin__InfluenzaA__ADJ00501

SEQ ID NO: 66153 - RNA, 1701 nt, Artificial Sequence; identical to SEQ ID NO: 64841
  derived and/or modified sequence opt1 from hemagglutinin__InfluenzaA__ADJ18163

SEQ ID NO: 66154 - RNA, 1701 nt, Artificial Sequence; identical to SEQ ID NO: 64841
  derived and/or modified sequence opt1 from hemagglutinin__InfluenzaA__ADJ18165

SEQ ID NO: 66155 - RNA, 1701 nt, Artificial Sequence
  derived and/or modified sequence opt1 from hemagglutinin__InfluenzaA__ADJ18167
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccguacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 66156 - RNA, 1701 nt, Artificial Sequence
  derived and/or modified sequence opt1 from hemagglutinin__InfluenzaA__ADJ18169
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66157 - RNA, 1701 nt, Artificial Sequence
  derived and/or modified sequence opt1 from hemagglutinin__InfluenzaA__ADJ18171
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggcccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuaccagaaccugaucuggcucgugaagaaggggaacuccuaccccaagcugagcaaguccuacauccacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccgccagggccggaugaacuacuacuggacccugguggagcucggggacaagaucaccuucgaggcgaccggcaaccugguggucccccgcuacgccuucgccauggagcggaacgccgggagcggcaucaucaucuccgacacgcccgugcacaacugcaacacgaccugccagaccaccaccggcgccaucaacaccagccugccguuccagaacauccaccccaucaccaucgggaagugccccaaguacgugaaguccacgaagcuccgccuggcgaccggccugcggaacguccccagcauccagucccgcggccucuucggggccaucgccggguucaucgagggcggcuggaccgggaugguggacggcugguacggguaccaccaccagaacgagcagggcagcggguacgccgccgaccugaaguccacccagaacgcgaucgacaagaucacgaacaaggugaacagcgucaucgagaagaugaacacccaguucaccgccgugggcaaggaguucaaccaccuggagaagcggaucgagaaccucaacaagaaggucgacgacggcuuccuggacaucuggaccuacaacgccgagcugcucgugcugcuggagaacgagcgcacgcucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgcgaggagaucgacggcgugaagcuggaguccacccggaucuaccagauccuggcgaucuacagcaccgucgccuccagccucgugcugguggucagccugggggccaucuccuucuggaugugcagcaacggcucccuccagugccgcaucugcaucuga

SEQ ID NO: 66158 - RNA, 1701 nt, Artificial Sequence; identical to SEQ ID NO: 64841
  derived and/or modified sequence opt1 from hemagglutinin__InfluenzaA__ADJ18173

SEQ ID NO: 66159 - RNA, 1701 nt, Artificial Sequence; identical to SEQ ID NO: 64841
  derived and/or modified sequence opt1 from hemagglutinin__InfluenzaA__ADJ18175

SEQ ID NO: 66160 - RNA, 1701 nt, Artificial Sequence
  derived and/or modified sequence opt1 from hemagglutinin__InfluenzaA__ADJ18177
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacaucccguccgugcagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 66161 - RNA, 1701 nt, Artificial Sequence
  derived and/or modified sequence opt1 from hemagglutinin__InfluenzaA__ADJ40444
augaaggccauccuggugguccuccuguacaccuucgccaccgcgaacgccgacacgcugugcaucggcuaccacgccaacaacagcaccgacaccguggacaccgugcucaagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66162 - RNA, 1701 nt, Artificial Sequence
  derived and/or modified sequence opt1 from hemagglutinin__InfluenzaA__ADJ40454
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcguggagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66163 - RNA, 1701 nt, Artificial Sequence
  derived and/or modified sequence opt1 from hemagglutinin__InfluenzaA__ADJ40464
augaaggccauccuggugguccuccuguacaccuucgccaccgcgaacacggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcugauccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 66164 - RNA, 1701 nt, Artificial Sequence
  derived and/or modified sequence opt1 from hemagglutinin__InfluenzaA__ADJ40474
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgccggcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 66165 - RNA, 1701 nt, Artificial Sequence
  derived and/or modified sequence opt1 from hemagglutinin__InfluenzaA__ADJ40494
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagacccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66166 - RNA, 1701 nt, Artificial Sequence
  derived and/or modified sequence opt1 from hemagglutinin__InfluenzaA__ADJ40514
augaaggccgugcuggucgugcuccuguacaccuucgccaccacgaacgcggacacccugugcaucggcuaccacgccaacaacagcaccgacaccguggacacgguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcacguccgcggaccagcagagccuguaccagaacgccgacgccuacguguucgucggcaccucccgguacagcaagaaguucaagcccgagaucgccauccgcccgaaggugcggaaccaggagggccgcaugaacuacuacuggacccugguggagcccggggacaagaucaccuucgaggccacgggcaaccucgucgugccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 66167 - RNA, 1701 nt, Artificial Sequence; identical to SEQ ID NO: 63677
  derived and/or modified sequence opt1 from hemagglutinin__InfluenzaA__ADJ40524

SEQ ID NO: 66168 - RNA, 1701 nt, Artificial Sequence; identical to SEQ ID NO: 64030
  derived and/or modified sequence opt1 from hemagglutinin__InfluenzaA__ADJ40534

SEQ ID NO: 66169 - RNA, 1701 nt, Artificial Sequence
  derived and/or modified sequence opt1 from hemagglutinin__InfluenzaA__ADJ40554
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaacaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66170 - RNA, 1701 nt, Artificial Sequence; identical to SEQ ID NO: 63677
  derived and/or modified sequence opt1 from hemagglutinin__InfluenzaA__ADJ40564

SEQ ID NO: 66171 - RNA, 1701 nt, Artificial Sequence; identical to SEQ ID NO: 63677
  derived and/or modified sequence opt1 from hemagglutinin__InfluenzaA__ADJ40574

SEQ ID NO: 66172 - RNA, 1701 nt, Artificial Sequence; identical to SEQ ID NO: 65097
  derived and/or modified sequence opt1 from hemagglutinin__InfluenzaA__ADJ40584

SEQ ID NO: 66173 - RNA, 1701 nt, Artificial Sequence; identical to SEQ ID NO: 63677
  derived and/or modified sequence opt1 from hemagglutinin__InfluenzaA__ADJ40594

SEQ ID NO: 66174 - RNA, 1701 nt, Artificial Sequence; identical to SEQ ID NO: 64246
  derived and/or modified sequence opt1 from hemagglutinin__InfluenzaA__ADJ40604

SEQ ID NO: 66175 - RNA, 1701 nt, Artificial Sequence; identical to SEQ ID NO: 64246
  derived and/or modified sequence opt1 from hemagglutinin__InfluenzaA__ADJ40614

SEQ ID NO: 66176 - RNA, 1701 nt, Artificial Sequence; identical to SEQ ID NO: 63677
  derived and/or modified sequence opt1 from hemagglutinin__InfluenzaA__ADJ40634

SEQ ID NO: 66177 - RNA, 1701 nt, Artificial Sequence; identical to SEQ ID NO: 63677
  derived and/or modified sequence opt1 from hemagglutinin__InfluenzaA__ADJ40644

SEQ ID NO: 66178 - RNA, 1701 nt, Artificial Sequence; identical to SEQ ID NO: 63677
  derived and/or modified sequence opt1 from hemagglutinin__InfluenzaA__ADJ40654

SEQ ID NO: 66179 - RNA, 1701 nt, Artificial Sequence; identical to SEQ ID NO: 63677
  derived and/or modified sequence opt1 from hemagglutinin__InfluenzaA__ADJ40664

SEQ ID NO: 66180 - RNA, 1701 nt, Artificial Sequence; identical to SEQ ID NO: 63677
  derived and/or modified sequence opt1 from hemagglutinin__InfluenzaA__ADJ40674

SEQ ID NO: 66181 - RNA, 1701 nt, Artificial Sequence
  derived and/or modified sequence opt1 from hemagglutinin__InfluenzaA__ADJ41816
augaagaccaucaucgcccugagcuacauguucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagagcgggggcuccugcacgugcaagcgcgggagcaacgacuccuucuucagccggcugaacuggcucuacgaguccgagagcaaguaccccgugcugaacgucaccaugcccaacaacggcaaguucgacaagcuguacaucuggggcauccaccaccccuccaccgacaaggagcagaccaaccucuacauccgcgccagcgggcgggugaccgugagcacgaagcgcucccagcagaccgucaucccgaacaucggcagccggcccugggugcgcgggcuguccagccggaucuccaucuacuggaccaucgugaagcccggcgacauccugcucaucagcuccaccggcaaccugaucgcgccccgcggguacuucaagauccggacgggcaagagcuccaucaugcgcagcgacgccccgaucgggaccugcuccagcgagugcaucacccccaacggcuccauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacagcgagggcaccgggcaggcggccgaccugaaguccacgcaggccgccaucgaccagaucaacggcaagcugaaccgggugaucgagaagaccaacgagaaguuccaccagaucgagaaggaguucagcgagguggaggggcgcauccaggaccucgagaaguacgucgaggacaccaagaucgaccugugguccuacaacgccgagcugcucguggcgcuggagaaccagcacaccaucgaccugacggacagcgagaugaacaagcuguucgagaagacccggaagcagcuccgcgagaacgccgaggacaugggcaacgggugcuucaagaucuaccacaagugcgacaacgccugcaucggcuccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcucugcgugguccugcugggguucaucaugugggcgugccagaagggcaacauccggugcaacaucugcaucuga

SEQ ID NO: 66182 - RNA, 1701 nt, Artificial Sequence; identical to SEQ ID NO: 63677
  derived and/or modified sequence opt1 from hemagglutinin__InfluenzaA__ADJ56640

SEQ ID NO: 66183 - RNA, 1701 nt, Artificial Sequence; identical to SEQ ID NO: 64475
  derived and/or modified sequence opt1 from hemagglutinin__InfluenzaA__ADJ56650

SEQ ID NO: 66184 - RNA, 1701 nt, Artificial Sequence; identical to SEQ ID NO: 63768
  derived and/or modified sequence opt1 from hemagglutinin__InfluenzaA__ADJ67983

SEQ ID NO: 66185 - RNA, 1701 nt, Artificial Sequence; identical to SEQ ID NO: 63768
  derived and/or modified sequence opt1 from hemagglutinin__InfluenzaA__ADJ67984

SEQ ID NO: 66186 - RNA, 1701 nt, Artificial Sequence; identical to SEQ ID NO: 63768
  derived and/or modified sequence opt1 from hemagglutinin__InfluenzaA__ADJ67985

SEQ ID NO: 66187 - RNA, 1701 nt, Artificial Sequence
  derived and/or modified sequence opt1 from hemagglutinin__InfluenzaA__ADJ80241
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66188 - RNA, 1701 nt, Artificial Sequence
  derived and/or modified sequence opt1 from hemagglutinin__InfluenzaA__ADJ80242
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgccgccagcagccugguccucguggugucccugggggccaucagcuucuggaugugcuccaacggcagccugcagugccggaucugcaucuga

SEQ ID NO: 66189 - RNA, 1701 nt, Artificial Sequence; identical to SEQ ID NO: 65229
  derived and/or modified sequence opt1 from hemagglutinin__InfluenzaA__ADJ80243

SEQ ID NO: 66190 - RNA, 1701 nt, Artificial Sequence; identical to SEQ ID NO: 63677
  derived and/or modified sequence opt1 from hemagglutinin__InfluenzaA__ADJ80634

SEQ ID NO: 66191 - RNA, 1701 nt, Artificial Sequence; identical to SEQ ID NO: 65679
  derived and/or modified sequence opt1 from hemagglutinin__InfluenzaA__ADJ80644

SEQ ID NO: 66192 - RNA, 1701 nt, Artificial Sequence; identical to SEQ ID NO: 65679
  derived and/or modified sequence opt1 from hemagglutinin__InfluenzaA__ADJ80654

SEQ ID NO: 66193 - RNA, 1701 nt, Artificial Sequence; identical to SEQ ID NO: 64841
  derived and/or modified sequence opt1 from hemagglutinin__InfluenzaA__ADJ80674

SEQ ID NO: 66194 - RNA, 1701 nt, Artificial Sequence; identical to SEQ ID NO: 64841
  derived and/or modified sequence opt1 from hemagglutinin__InfluenzaA__ADJ80684

SEQ ID NO: 66195 - RNA, 1701 nt, Artificial Sequence
  derived and/or modified sequence opt1 from hemagglutinin__InfluenzaA__ADJ80694
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaaccacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccgccgccagcucccuggugcugguggucagccucggggccaucuccuucuggaugugcagcaacggcucccugcagugccggaucugcaucuga

SEQ ID NO: 66196 - RNA, 1701 nt, Artificial Sequence; identical to SEQ ID NO: 64841
  derived and/or modified sequence opt1 from hemagglutinin__InfluenzaA__ADJ80704

SEQ ID NO: 66197 - RNA, 1701 nt, Artificial Sequence
  derived and/or modified sequence opt1 from hemagglutinin__InfluenzaA__ADJ80714
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgccgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 66198 - RNA, 1701 nt, Artificial Sequence; identical to SEQ ID NO: 63677
  derived and/or modified sequence opt1 from hemagglutinin__InfluenzaA__ADJ80724

SEQ ID NO: 66199 - RNA, 1701 nt, Artificial Sequence; identical to SEQ ID NO: 64841
  derived and/or modified sequence opt1 from hemagglutinin__InfluenzaA__ADJ80734

SEQ ID NO: 66200 - RNA, 1701 nt, Artificial Sequence; identical to SEQ ID NO: 64841
  derived and/or modified sequence opt1 from hemagglutinin__InfluenzaA__ADJ80744

SEQ ID NO: 66201 - RNA, 1701 nt, Artificial Sequence; identical to SEQ ID NO: 64841
  derived and/or modified sequence opt1 from hemagglutinin__InfluenzaA__ADJ80754

SEQ ID NO: 66202 - RNA, 1701 nt, Artificial Sequence
  derived and/or modified sequence opt1 from hemagglutinin__InfluenzaA__ADJ80774
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgcgaacagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucagcaaguccuacaucaacgacaagggcaaggaggugcugguccugugggggauccaccaccccagcaccagcgccgaccagcagucccucuaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucagcgacacccccgugcacgacugcaacacgaccugccagaccccgaagggcgccaucaacaccucccuccccuuccagaacauccaccccaucacgaucgggaagugccccaaguacgucaagagcaccaagcugcggcuggcgaccggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagguggggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccgccgccagcagccuggugcugguggucucccucggggccaucagcuucuggaugugcuccaacggcagccugcagugccggaucugcaucuga

SEQ ID NO: 66203 - RNA, 1701 nt, Artificial Sequence
  derived and/or modified sequence opt1 from hemagglutinin__InfluenzaA__ADJ80784
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66204 - RNA, 1701 nt, Artificial Sequence; identical to SEQ ID NO: 64841
  derived and/or modified sequence opt1 from hemagglutinin__InfluenzaA__ADJ80794

SEQ ID NO: 66205 - RNA, 1701 nt, Artificial Sequence; identical to SEQ ID NO: 65679
  derived and/or modified sequence opt1 from hemagglutinin__InfluenzaA__ADJ80804

SEQ ID NO: 66206 - RNA, 1701 nt, Artificial Sequence
  derived and/or modified sequence opt1 from hemagglutinin__InfluenzaA__ADJ80814
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcgggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccaucgagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66207 - RNA, 1701 nt, Artificial Sequence
  derived and/or modified sequence opt1 from hemagglutinin__InfluenzaA__ADJ80834
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacuccgggagcggcaucaucaucuccgacacccccgugcacuacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgccagcucccuggugcucguggucagccugggggcgaucuccuucuggaugugcagcaacggcucccugcagugccggaucugcaucuga

SEQ ID NO: 66208 - RNA, 1701 nt, Artificial Sequence; identical to SEQ ID NO: 65879
  derived and/or modified sequence opt1 from hemagglutinin__InfluenzaA__ADJ80848

SEQ ID NO: 66209 - RNA, 1701 nt, Artificial Sequence
  derived and/or modified sequence opt1 from hemagglutinin__InfluenzaA__ADJ80858
augaagaccauccuggugguccuccuguacaccuucgccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66210 - RNA, 1701 nt, Artificial Sequence
  derived and/or modified sequence opt1 from hemagglutinin__InfluenzaA__ADJ80868
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgaacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccgggggcaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 66211 - RNA, 1701 nt, Artificial Sequence; identical to SEQ ID NO: 64841
  derived and/or modified sequence opt1 from hemagglutinin__InfluenzaA__ADJ80883

SEQ ID NO: 66212 - RNA, 1701 nt, Artificial Sequence; identical to SEQ ID NO: 64841
  derived and/or modified sequence opt1 from hemagglutinin__InfluenzaA__ADJ80893

SEQ ID NO: 66213 - RNA, 1701 nt, Artificial Sequence; identical to SEQ ID NO: 64841
  derived and/or modified sequence opt1 from hemagglutinin__InfluenzaA__ADJ80910

SEQ ID NO: 66214 - RNA, 1701 nt, Artificial Sequence; identical to SEQ ID NO: 63677
  derived and/or modified sequence opt1 from hemagglutinin__InfluenzaA__ADJ80927

SEQ ID NO: 66215 - RNA, 1701 nt, Artificial Sequence
  derived and/or modified sequence opt1 from hemagglutinin__InfluenzaA__ADJ80937
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacgccuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacaacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagucccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgggaggagaucgacggcgugaagcucgaguccacccgcaucuaccagauccuggccaucuacagcaccguggccagcucccugguccucguggugagccugggggccaucuccuucuggaugugcagcaacggcucccugcagugccggaucugcaucuga

SEQ ID NO: 66216 - RNA, 1701 nt, Artificial Sequence; identical to SEQ ID NO: 64841
  derived and/or modified sequence opt1 from hemagglutinin__InfluenzaA__ADJ80947

SEQ ID NO: 66217 - RNA, 1701 nt, Artificial Sequence; identical to SEQ ID NO: 64841
  derived and/or modified sequence opt1 from hemagglutinin__InfluenzaA__ADJ80967

SEQ ID NO: 66218 - RNA, 1701 nt, Artificial Sequence; identical to SEQ ID NO: 64841
  derived and/or modified sequence opt1 from hemagglutinin__InfluenzaA__ADJ80977

SEQ ID NO: 66219 - RNA, 1701 nt, Artificial Sequence
  derived and/or modified sequence opt1 from hemagglutinin__InfluenzaA__ADJ80993
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgaacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66220 - RNA, 1701 nt, Artificial Sequence
  derived and/or modified sequence opt1 from hemagglutinin__InfluenzaA__ADJ81003
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66221 - RNA, 1701 nt, Artificial Sequence; identical to SEQ ID NO: 65879
  derived and/or modified sequence opt1 from hemagglutinin__InfluenzaA__ADJ81013

SEQ ID NO: 66222 - RNA, 1701 nt, Artificial Sequence
  derived and/or modified sequence opt1 from hemagglutinin__InfluenzaA__ADJ81023
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66223 - RNA, 1701 nt, Artificial Sequence; identical to SEQ ID NO: 64841
  derived and/or modified sequence opt1 from hemagglutinin__InfluenzaA__ADJ81033

SEQ ID NO: 66224 - RNA, 1701 nt, Artificial Sequence; identical to SEQ ID NO: 63677
  derived and/or modified sequence opt1 from hemagglutinin__InfluenzaA__ADJ81043

SEQ ID NO: 66225 - RNA, 1701 nt, Artificial Sequence
  derived and/or modified sequence opt1 from hemagglutinin__InfluenzaA__ADJ81053
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66226 - RNA, 1701 nt, Artificial Sequence; identical to SEQ ID NO: 64841
  derived and/or modified sequence opt1 from hemagglutinin__InfluenzaA__ADJ81063

SEQ ID NO: 66227 - RNA, 1701 nt, Artificial Sequence; identical to SEQ ID NO: 64621
  derived and/or modified sequence opt1 from hemagglutinin__InfluenzaA__ADJ84772

SEQ ID NO: 66228 - RNA, 1701 nt, Artificial Sequence
  derived and/or modified sequence opt1 from hemagglutinin__InfluenzaA__ADJ88782
augaagaccaucaucgcccugagcuacaugcucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugggggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 66229 - RNA, 1701 nt, Artificial Sequence
  derived and/or modified sequence opt1 from hemagglutinin__InfluenzaA__ADK21733
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgcccacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66230 - RNA, 1701 nt, Artificial Sequence
  derived and/or modified sequence opt1 from hemagglutinin__InfluenzaA__ADK21743
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucuccaacagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgcccacgacugcaacacgaccugccagaccccgaagggcgcgaucaacaccucccuccccuuccagaacauccaccccaucaccaucgggaagugccccaaguacgucaagagcaccaagcugcggcuggccaccggccuccgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcuggagagcacccgcaucuaccagauccucgccaucuacuccaccguggccagcagccugguccugguggugucccucggggccaucagcuucuggaugugcuccaacggcagccugcagugccggaucugcaucuga

SEQ ID NO: 66231 - RNA, 1701 nt, Artificial Sequence
  derived and/or modified sequence opt1 from hemagglutinin__InfluenzaA__ADK21753
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggaggggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 66232 - RNA, 1701 nt, Artificial Sequence
  derived and/or modified sequence opt1 from hemagglutinin__InfluenzaA__ADK21763
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66233 - RNA, 1701 nt, Artificial Sequence; identical to SEQ ID NO: 64841
  derived and/or modified sequence opt1 from hemagglutinin__InfluenzaA__ADK21773

SEQ ID NO: 66234 - RNA, 1701 nt, Artificial Sequence; identical to SEQ ID NO: 64841
  derived and/or modified sequence opt1 from hemagglutinin__InfluenzaA__ADK21783

SEQ ID NO: 66235 - RNA, 1701 nt, Artificial Sequence; identical to SEQ ID NO: 63677
  derived and/or modified sequence opt1 from hemagglutinin__InfluenzaA__ADK21813

SEQ ID NO: 66236 - RNA, 1701 nt, Artificial Sequence; identical to SEQ ID NO: 65097
  derived and/or modified sequence opt1 from hemagglutinin__InfluenzaA__ADK21823

SEQ ID NO: 66237 - RNA, 1701 nt, Artificial Sequence
  derived and/or modified sequence opt1 from hemagglutinin__InfluenzaA__ADK21833
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcgggacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66238 - RNA, 1701 nt, Artificial Sequence; identical to SEQ ID NO: 64841
  derived and/or modified sequence opt1 from hemagglutinin__InfluenzaA__ADK21843

SEQ ID NO: 66239 - RNA, 1701 nt, Artificial Sequence; identical to SEQ ID NO: 64030
  derived and/or modified sequence opt1 from hemagglutinin__InfluenzaA__ADK21853

SEQ ID NO: 66240 - RNA, 1701 nt, Artificial Sequence; identical to SEQ ID NO: 65326
  derived and/or modified sequence opt1 from hemagglutinin__InfluenzaA__ADK21863

SEQ ID NO: 66241 - RNA, 1701 nt, Artificial Sequence; identical to SEQ ID NO: 64124
  derived and/or modified sequence opt1 from hemagglutinin__InfluenzaA__ADK21873

SEQ ID NO: 66242 - RNA, 1701 nt, Artificial Sequence
  derived and/or modified sequence opt1 from hemagglutinin__InfluenzaA__ADK21883
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucgugguccccaaguacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 66243 - RNA, 1701 nt, Artificial Sequence; identical to SEQ ID NO: 63677
  derived and/or modified sequence opt1 from hemagglutinin__InfluenzaA__ADK21893

SEQ ID NO: 66244 - RNA, 1701 nt, Artificial Sequence; identical to SEQ ID NO: 65274
  derived and/or modified sequence opt1 from hemagglutinin__InfluenzaA__ADK21903

SEQ ID NO: 66245 - RNA, 1701 nt, Artificial Sequence; identical to SEQ ID NO: 65387
  derived and/or modified sequence opt1 from hemagglutinin__InfluenzaA__ADK21913

SEQ ID NO: 66246 - RNA, 1701 nt, Artificial Sequence
  derived and/or modified sequence opt1 from hemagglutinin__InfluenzaA__ADK21923
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaaggcccgcucccagcucaagaacaacgccaaggagaucgggaacggcugcuucgaguucuaccacaagugcgacaacacgugcauggagagcgucaagaacgggaccuacgacuaccccaaguacuccgaggaggcgaagcugaaccgggagaagaucgacggcgugaagcuggagagcacccgcaucuaccagauccucgccaucuacuccaccguggccagcacccugguccugguggugagccucggggccaucuccuucuggaugugcagcaacggcucccugcagugccggaucugcaucuga

SEQ ID NO: 66247 - RNA, 1701 nt, Artificial Sequence
  derived and/or modified sequence opt1 from hemagglutinin__InfluenzaA__ADK21933
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgaacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66248 - RNA, 1701 nt, Artificial Sequence; identical to SEQ ID NO: 63677
  derived and/or modified sequence opt1 from hemagglutinin__InfluenzaA__ADK21943

SEQ ID NO: 66249 - RNA, 1701 nt, Artificial Sequence
  derived and/or modified sequence opt1 from hemagglutinin__InfluenzaA__ADK21953
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgaccacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggccauccaccaccccagcaccuccgccgaccagcagagccuguaccagaacgccgacgccuacguguucguggggacgucccgguacagcaagaaguucaagcccgagaucgcgauccgcccgaagguccgggaccaggagggccgcaugaacuacuacuggacccugguggagcccggcgacaagaucaccuucgaggccaccgggaaccucguggucccccgguacgccuucgccauggagcgcaacgccggcuccgggaucaucaucagcgacacgcccgugcacgacugcaacacgaccugccagaccccgaagggcgcgaucaacaccucccugcccuuccagaacauccaccccaucaccaucggcaagugccccaaguacgucaagagcaccaagcugcggcucgccaccgggcugcgcaacgugccguccauccagagccggggccuguucggggccaucgccggcuucaucgagggcggguggacgggcaugguggacgggugguacggcuaccaccaccagaacgagcagggguccggcuacgccgcggaccucaagagcacccagaacgccaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcucgagagcacccgcaucuaccagauccuggccaucuacuccaccgucgccagcagccuggugcucguggucucccugggcgccaucagcuucuggaugugcuccaacgggagccugcagugccggaucugcaucuga

SEQ ID NO: 66250 - RNA, 1701 nt, Artificial Sequence; identical to SEQ ID NO: 65864
  derived and/or modified sequence opt1 from hemagglutinin__InfluenzaA__ADK32390

SEQ ID NO: 66251 - RNA, 1701 nt, Artificial Sequence; identical to SEQ ID NO: 65864
  derived and/or modified sequence opt1 from hemagglutinin__InfluenzaA__ADK32400

SEQ ID NO: 66252 - RNA, 1701 nt, Artificial Sequence
  derived and/or modified sequence opt1 from hemagglutinin__InfluenzaA__ADK32420
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66253 - RNA, 1701 nt, Artificial Sequence; identical to SEQ ID NO: 65229
  derived and/or modified sequence opt1 from hemagglutinin__InfluenzaA__ADK32430

SEQ ID NO: 66254 - RNA, 1701 nt, Artificial Sequence
  derived and/or modified sequence opt1 from hemagglutinin__InfluenzaA__ADK32440
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacggcaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 66255 - RNA, 1701 nt, Artificial Sequence
  derived and/or modified sequence opt1 from hemagglutinin__InfluenzaA__ADK32450
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacgcccccgugcacgacugcaacaccacgugccagaccccgaagggcgcgaucaacaccagccuccccuuccagaacauccaccccaucaccaucgggaagugccccaaguacgugaaguccacgaagcugcggcuggccaccggccuccgcaacgucccgagcauccagucccgggggcuguucggcgccaucgccggguucaucgagggcggcuggaccgggaugguggacggcugguacggguaccaccaccagaacgagcagggcagcggguacgccgcggaccugaaguccacccagaacgccaucgacgagaucacgaacaaggugaacagcgucaucgagaagaugaacacccaguucaccgccgugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggcgaagcugaaccgggaggagaucgacggcgucaagcuggaguccacccgcaucuaccagauccucgccaucuacagcaccgccgccagcucccuggugcugguggucagccucggggcgaucuccuucuggaugugcagcaacggcucccugcagugccggaucugcaucuga

SEQ ID NO: 66256 - RNA, 1701 nt, Artificial Sequence
  derived and/or modified sequence opt1 from hemagglutinin__InfluenzaA__ADK32460
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacgccuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 66257 - RNA, 1701 nt, Artificial Sequence; identical to SEQ ID NO: 64841
  derived and/or modified sequence opt1 from hemagglutinin__InfluenzaA__ADK32470

SEQ ID NO: 66258 - RNA, 1701 nt, Artificial Sequence
  derived and/or modified sequence opt1 from hemagglutinin__InfluenzaA__ADK32480
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 66259 - RNA, 1701 nt, Artificial Sequence; identical to SEQ ID NO: 64841
  derived and/or modified sequence opt1 from hemagglutinin__InfluenzaA__ADK32490

SEQ ID NO: 66260 - RNA, 1701 nt, Artificial Sequence; identical to SEQ ID NO: 64841
  derived and/or modified sequence opt1 from hemagglutinin__InfluenzaA__ADK32502

SEQ ID NO: 66261 - RNA, 1701 nt, Artificial Sequence; identical to SEQ ID NO: 65313
  derived and/or modified sequence opt1 from hemagglutinin__InfluenzaA__ADK32637

SEQ ID NO: 66262 - RNA, 1701 nt, Artificial Sequence; identical to SEQ ID NO: 64841
  derived and/or modified sequence opt1 from hemagglutinin__InfluenzaA__ADK32647

SEQ ID NO: 66263 - RNA, 1701 nt, Artificial Sequence; identical to SEQ ID NO: 65005
  derived and/or modified sequence opt1 from hemagglutinin__InfluenzaA__ADK32657

SEQ ID NO: 66264 - RNA, 1701 nt, Artificial Sequence; identical to SEQ ID NO: 65229
  derived and/or modified sequence opt1 from hemagglutinin__InfluenzaA__ADK32677

SEQ ID NO: 66265 - RNA, 1701 nt, Artificial Sequence
  derived and/or modified sequence opt1 from hemagglutinin__InfluenzaA__ADK32687
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagaacuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66266 - RNA, 1701 nt, Artificial Sequence; identical to SEQ ID NO: 65468
  derived and/or modified sequence opt1 from hemagglutinin__InfluenzaA__ADK32697

SEQ ID NO: 66267 - RNA, 1701 nt, Artificial Sequence; identical to SEQ ID NO: 64841
  derived and/or modified sequence opt1 from hemagglutinin__InfluenzaA__ADK32776

SEQ ID NO: 66268 - RNA, 1701 nt, Artificial Sequence; identical to SEQ ID NO: 65229
  derived and/or modified sequence opt1 from hemagglutinin__InfluenzaA__ADK33621

SEQ ID NO: 66269 - RNA, 1701 nt, Artificial Sequence
  derived and/or modified sequence opt1 from hemagglutinin__InfluenzaA__ADK33631
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggucaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66270 - RNA, 1701 nt, Artificial Sequence; identical to SEQ ID NO: 65229
  derived and/or modified sequence opt1 from hemagglutinin__InfluenzaA__ADK33641

SEQ ID NO: 66271 - RNA, 1701 nt, Artificial Sequence; identical to SEQ ID NO: 64841
  derived and/or modified sequence opt1 from hemagglutinin__InfluenzaA__ADK33651

SEQ ID NO: 66272 - RNA, 1701 nt, Artificial Sequence; identical to SEQ ID NO: 64841
  derived and/or modified sequence opt1 from hemagglutinin__InfluenzaA__ADK33661

SEQ ID NO: 66273 - RNA, 1701 nt, Artificial Sequence; identical to SEQ ID NO: 64841
  derived and/or modified sequence opt1 from hemagglutinin__InfluenzaA__ADK33671

SEQ ID NO: 66274 - RNA, 1701 nt, Artificial Sequence
  derived and/or modified sequence opt1 from hemagglutinin__InfluenzaA__ADK33681
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66275 - RNA, 1701 nt, Artificial Sequence; identical to SEQ ID NO: 65290
  derived and/or modified sequence opt1 from hemagglutinin__InfluenzaA__ADK33691

SEQ ID NO: 66276 - RNA, 1701 nt, Artificial Sequence
  derived and/or modified sequence opt1 from hemagglutinin__InfluenzaA__ADK33701
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcgucuaccagauccuggcgaucuacuccaccguggccagcagccuggugcucgucgugucccugggggccaucagcuucuggaugugcuccaacggcagccugcagugccggaucugcaucuga

SEQ ID NO: 66277 - RNA, 1701 nt, Artificial Sequence
  derived and/or modified sequence opt1 from hemagglutinin__InfluenzaA__ADK33711
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggagauccuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66278 - RNA, 1701 nt, Artificial Sequence
  derived and/or modified sequence opt1 from hemagglutinin__InfluenzaA__ADK33721
augaaggccauccuggugguccuccuguacaccuucgugaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 66279 - RNA, 1701 nt, Artificial Sequence
  derived and/or modified sequence opt1 from hemagglutinin__InfluenzaA__ADK33731
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccggcaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcacguccgccgaccagcagagccuguaccagaacgccgacgccuacgccuucgugggcaccucccgguacagcaagaaguucaagcccgagaucgcgauccgcccgaaggugcgggaccaggaggggcgcaugaacuacuacuggacccuggucgagcccggcgacaagaucaccuucgaggccacggggaaccuccuggugccccgguacgccuucgccauggagcgcaacgccggcuccggcaucaucaucagcgacacccccgugcacgacugcaacacgaccugccagaccccgaagggggcgaucaacaccucccugcccuuccagaacauccaccccaucaccaucggcaagugccccaaguacgucaagagcaccaagcuccggcuggccacggggcugcgcaacgugccguccauccagagccggggccucuucggggccaucgccggcuucaucgagggcggguggaccggcaugguggacgggugguacggcuaccaccaccagaacgagcagggguccggcuacgccgcggaccucaagagcacccagaacgccaucgacgagaucaccaacaaggucaacuccgugaucgagaagaugaacacgcaguucaccgccgugggcaaggaguucaaccaccuggagaagcgcaucgagaaccugaacaagaaggucgacgacggguuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcucaaccgggaggagaucgacggggucaagcuggagagcacccgcaucuaccagauccuggccaucuacuccaccguggccagcagccucgugcuggucgugucccugggcgccaucagcuucuggaugugcuccaacggcagccuccagugccggaucugcaucuga

SEQ ID NO: 66280 - RNA, 1701 nt, Artificial Sequence; identical to SEQ ID NO: 65844
  derived and/or modified sequence opt1 from hemagglutinin__InfluenzaA__ADK33741

SEQ ID NO: 66281 - RNA, 1701 nt, Artificial Sequence; identical to SEQ ID NO: 63677
  derived and/or modified sequence opt1 from hemagglutinin__InfluenzaA__ADK33751

SEQ ID NO: 66282 - RNA, 1701 nt, Artificial Sequence
  derived and/or modified sequence opt1 from hemagglutinin__InfluenzaA__ADK33761
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugucccucgcgaccggccugcggaacgugccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 66283 - RNA, 1701 nt, Artificial Sequence; identical to SEQ ID NO: 64841
  derived and/or modified sequence opt1 from hemagglutinin__InfluenzaA__ADK33771

SEQ ID NO: 66284 - RNA, 1701 nt, Artificial Sequence; identical to SEQ ID NO: 64841
  derived and/or modified sequence opt1 from hemagglutinin__InfluenzaA__ADK33781

SEQ ID NO: 66285 - RNA, 1701 nt, Artificial Sequence; identical to SEQ ID NO: 64778
  derived and/or modified sequence opt1 from hemagglutinin__InfluenzaA__ADK33791

SEQ ID NO: 66286 - RNA, 1701 nt, Artificial Sequence; identical to SEQ ID NO: 66276
  derived and/or modified sequence opt1 from hemagglutinin__InfluenzaA__ADK33801

SEQ ID NO: 66287 - RNA, 1701 nt, Artificial Sequence
  derived and/or modified sequence opt1 from hemagglutinin__InfluenzaA__ADK33811
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcaucaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66288 - RNA, 1701 nt, Artificial Sequence
  derived and/or modified sequence opt1 from hemagglutinin__InfluenzaA__ADK33821
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucgccgugagccugggggccaucuccuucuggaugugcagcaacggcucccugcagugccggaucugcaucuga

SEQ ID NO: 66289 - RNA, 1701 nt, Artificial Sequence
  derived and/or modified sequence opt1 from hemagglutinin__InfluenzaA__ADK33831
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaacaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66290 - RNA, 1701 nt, Artificial Sequence; identical to SEQ ID NO: 65097
  derived and/or modified sequence opt1 from hemagglutinin__InfluenzaA__ADK33841

SEQ ID NO: 66291 - RNA, 1701 nt, Artificial Sequence; identical to SEQ ID NO: 65844
  derived and/or modified sequence opt1 from hemagglutinin__InfluenzaA__ADK33851

SEQ ID NO: 66292 - RNA, 1701 nt, Artificial Sequence; identical to SEQ ID NO: 63677
  derived and/or modified sequence opt1 from hemagglutinin__InfluenzaA__ADK33861

SEQ ID NO: 66293 - RNA, 1701 nt, Artificial Sequence
  derived and/or modified sequence opt1 from hemagglutinin__InfluenzaA__ADK33871
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucgugaucccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccuccuggugucccugggggccaucagcuucuggaugugcuccaacggcagccuccagugccggaucugcaucuga

SEQ ID NO: 66294 - RNA, 1701 nt, Artificial Sequence
  derived and/or modified sequence opt1 from hemagglutinin__InfluenzaA__ADK33881
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcaccaagaucuaccagauccucgcgaucuacuccaccgucgccagcagccuggugcugguggucucccucggggccaucagcuucuggaugugcuccaacggcagccugcagugccgcaucugcaucuga

SEQ ID NO: 66295 - RNA, 1701 nt, Artificial Sequence
  derived and/or modified sequence opt1 from hemagglutinin__InfluenzaA__ADK33891
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 66296 - RNA, 1701 nt, Artificial Sequence; identical to SEQ ID NO: 65844
  derived and/or modified sequence opt1 from hemagglutinin__InfluenzaA__ADK33901

SEQ ID NO: 66297 - RNA, 1701 nt, Artificial Sequence
  derived and/or modified sequence opt1 from hemagglutinin__InfluenzaA__ADK33911
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucaucaagaagggcaacagcuaccccaagcuguccaagagcuacaucaacgacaaggggaaggaggugcuggugcucuggggcauccaccaccccagcaccuccgccgaccagcagagccuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaacggcagccugcagugccggaucugcaucuga

SEQ ID NO: 66298 - RNA, 1701 nt, Artificial Sequence
  derived and/or modified sequence opt1 from hemagglutinin__InfluenzaA__ADK33931
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcuccuggugucccugggggccaucagcuucuggaugugcuccaacggcagccuccagugccggaucugcaucuga

SEQ ID NO: 66299 - RNA, 1701 nt, Artificial Sequence
  derived and/or modified sequence opt1 from hemagglutinin__InfluenzaA__ADK33941
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66300 - RNA, 1701 nt, Artificial Sequence; identical to SEQ ID NO: 66297
  derived and/or modified sequence opt1 from hemagglutinin__InfluenzaA__ADK33951

SEQ ID NO: 66301 - RNA, 1701 nt, Artificial Sequence; identical to SEQ ID NO: 64841
  derived and/or modified sequence opt1 from hemagglutinin__InfluenzaA__ADK33961

SEQ ID NO: 66302 - RNA, 1701 nt, Artificial Sequence; identical to SEQ ID NO: 64621
  derived and/or modified sequence opt1 from hemagglutinin__InfluenzaA__ADK45312

SEQ ID NO: 66303 - RNA, 1701 nt, Artificial Sequence
  derived and/or modified sequence opt1 from hemagglutinin__InfluenzaA__ADK45410
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacacgugcaucggguccauccgcaacggcaccuacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66304 - RNA, 1701 nt, Artificial Sequence
  derived and/or modified sequence opt1 from hemagglutinin__InfluenzaA__ADK45421
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagagcacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66305 - RNA, 1701 nt, Artificial Sequence
  derived and/or modified sequence opt1 from hemagglutinin__InfluenzaA__ADK45432
augaagaccaucaucgcccugagcuacacccucugccugguguucgcccagaagcugccccgcaacgacaacuccacggcgacccucugccugggccaccacgccgucccgaacgggaccaucgugaagaccaucacgaacgaccagaucgaggugaccaacgccaccgagcugguccagagcuccagcaccggcgagaucugcgacaacccccaccagauccucgacggggagaacugcacgcugaucgacgcccugcucggcgacccccagugcgacggguuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaccggcgugacccagaacgggacgagcuccgccugcauccggcgcagcaacaacuccuucuucagccggcugaacuggcucacccaccugaaguucaaguaccccgcccugaacgugaccaugcccaacaacgagcaguucgacaagcucuacaucuggggcguccaccaccccgggaccgacaacgaccagaucuuccuguacgcgcaggccuccggccgcaucacggugagcaccaagcggucccagcagaccgugaucccgaacaucgggagccgcccccggguccgcaacauccccagccggaucuccaucuacuggaccaucgugaagcccggcgacauccugcucaucaacagcacgggcaaccugaucgccccgcgcggguacuucaagauccgguccggcaagagcuccaucaugcgcagcgacgcccccaucgggaagugcaacuccgagugcaucacccccaacggcagcauccccaacgacaagccguuccagaacgugaaccggaucaccuacggcgccugcccccgcuacgucaagcagaacacccugaagcucgcgacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacccaggcggccaucgaccagaucaacggcaagcugaaccggcugaucgggaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 66306 - RNA, 1701 nt, Artificial Sequence; identical to SEQ ID NO: 63442
  derived and/or modified sequence opt1 from hemagglutinin__InfluenzaA__ADK45443

SEQ ID NO: 66307 - RNA, 1701 nt, Artificial Sequence; identical to SEQ ID NO: 65841
  derived and/or modified sequence opt1 from hemagglutinin__InfluenzaA__ADK48798

SEQ ID NO: 66308 - RNA, 1701 nt, Artificial Sequence; identical to SEQ ID NO: 64841
  derived and/or modified sequence opt1 from hemagglutinin__InfluenzaA__ADK62683

SEQ ID NO: 66309 - RNA, 1701 nt, Artificial Sequence
  derived and/or modified sequence opt1 from hemagglutinin__InfluenzaA__ADK62693
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggagcaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacgugcaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaacggcagccugcagugccggaucugcaucuga

SEQ ID NO: 66310 - RNA, 1701 nt, Artificial Sequence; identical to SEQ ID NO: 64778
  derived and/or modified sequence opt1 from hemagglutinin__InfluenzaA__ADK62703

SEQ ID NO: 66311 - RNA, 1701 nt, Artificial Sequence
  derived and/or modified sequence opt1 from hemagglutinin__InfluenzaA__ADK64992
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcaucaagcucgagagcacccgcaucuaccagauccuggcgaucuacuccaccguggccagcagccugguccucguggugucccugggggccaucagcuucuggaugugcuccaacggcagccugcaguaccggaucugcaucuga

SEQ ID NO: 66312 - RNA, 1701 nt, Artificial Sequence
  derived and/or modified sequence opt1 from hemagglutinin__InfluenzaA__ADK65001
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugccuggagagcgugaagaacggcaccuacgacuaccccaaguacuccgaggaggccaagcucaaccgcgaggagaucgacggggugaagcuggagagcacccggaucuaccagauccuggcgaucuacuccaccgucgccagcagccucgugcugguggucucccugggcgccaucagcuucuggaugugcuccaacggcagccuccagugccgcaucugcaucuga

SEQ ID NO: 66313 - RNA, 1701 nt, Artificial Sequence
  derived and/or modified sequence opt1 from hemagglutinin__InfluenzaA__ADK65009
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucggcgcgaccgggaaccucguggucccccgguacgccuucgccauggagcgcaacgccggcagcggcaucaucaucuccgacacgccggugcacgacugcaacacgaccugccagacccccaagggggccaucaacaccagccugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 66314 - RNA, 1701 nt, Artificial Sequence
  derived and/or modified sequence opt1 from hemagglutinin__InfluenzaA__ADK87287
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccugaucggcaagugcaacagcgagugcaucacgcccaacggcuccauccccaacgacaagcccuuccagaacgugaaccgcaucaccuacggggcgugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 66315 - RNA, 1701 nt, Artificial Sequence
  derived and/or modified sequence opt1 from hemagglutinin__InfluenzaA__ADK87288
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccaccgggcggaucacggugagcaccaagcgcucccagcagaccgccaucccgaacaucggcagccggccccgcgugcggaacauccccagccgcaucuccaucuacuggaccaucgucaagcccggcgacauccugcucaucaacagcacggggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucaccuacggggcgugcccccgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcacguacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 66316 - RNA, 1701 nt, Artificial Sequence
  derived and/or modified sequence opt1 from hemagglutinin__InfluenzaA__ADK87289
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcugggguucaacaacgagagcuucaacuggaccggcgugacccagaacgggaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcagaccgccaucccgaacaucggcagccggccccgcgugcggaacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccugggcaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggcgugccagaaggggaacauccggugcaacaucugcaucuga

SEQ ID NO: 66317 - RNA, 1701 nt, Artificial Sequence
  derived and/or modified sequence opt1 from hemagglutinin__InfluenzaA__ADK87291
augaagaccaucaucgcccugagcuacauccagugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucagccucuacgcgcaggccuccgggcggaucaccgugagcacgaagcgcagccagcagaccgccaucccgaacaucggcucccggccccgcgugcggaacauccccagccgcaucuccaucuacuggaccaucgucaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccucgggaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcucaaguccggcuacaaggacuggauccuguggaucagcuucgccaucuccugcuuccugcucugcguggcccugcugggguucaucaugugggcgugccagaagggcaacauccggugcaacaucugcaucuga

SEQ ID NO: 66318 - RNA, 1701 nt, Artificial Sequence
  derived and/or modified sequence opt1 from hemagglutinin__InfluenzaA__ADK87293
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgccgguccaagaacagcuucuucuccaagcugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcgcaucacgguguccaccaagcggagccagcagaccgccaucccgaacaucggcagccgcccccgggugcgcaacauccccucccggaucagcaucuacuggaccaucgucaagcccggcgacauccugcucaucaacuccacggggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucaccuacggggcgugcccccgcuacgugaagcagaacacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagauguccaagcuguucgagaagaccaagaagcagcugcgggagaacgcggaggacauggggaacggcugcuucaagaucuaccacaagugcgacaacgccugcaucgggagcauccgcaacggcacguacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 66319 - RNA, 1701 nt, Artificial Sequence
  derived and/or modified sequence opt1 from hemagglutinin__InfluenzaA__ADK87295
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcagccuggaguucaacaacgaguccuucaacuggacgggggugacccagaacggcaccagcuccgccugcauccgccggagcaagaacuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccuccgggcggaucaccgugagcaccaagcgcagccagcagacggccaucccgaacaucggcucccggccccgcgugcggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggcgcaacaucugcaucuga

SEQ ID NO: 66320 - RNA, 1701 nt, Artificial Sequence
  derived and/or modified sequence opt1 from hemagglutinin__InfluenzaA__ADK87296
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccggugcgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66321 - RNA, 1701 nt, Artificial Sequence
  derived and/or modified sequence opt1 from hemagglutinin__InfluenzaA__ADK87298
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacagcggcacgugcuaccccggcgacuucaucgacuacgaggagcuccgggagcagcuguccagcguguccagcuucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccggguccggcaacaucaucagcgacacgccggugcacgacugcaacacgaccugccagacccccaagggcgccaucaacaccucccugcccuuccagaacauccaccccaucaccaucgggaagugcccgaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaaccccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66322 - RNA, 1701 nt, Artificial Sequence
  derived and/or modified sequence opt1 from hemagglutinin__InfluenzaA__ADK87300
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagccuguucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucgcgcccaacggcuccauccccaacgacaagagcuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 66323 - RNA, 1701 nt, Artificial Sequence
  derived and/or modified sequence opt1 from hemagglutinin__InfluenzaA__ADK87302
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggcgugccagaaggggaacauccggugcgacaucugcaucuga

SEQ ID NO: 66324 - RNA, 1701 nt, Artificial Sequence
  derived and/or modified sequence opt1 from hemagglutinin__InfluenzaA__ADK87304
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcggcugcaucacgcccaacggguccauccccaacgacaagccguuccagaacgugaaccgcaucaccuacggcgcgugcccccgguacgugaagcagaacacccugaagcuggccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacggccacgacguguaccgggacgaggcccugaacaaccgcuuccagaucaagggcgucgagcucaagagcggguacaaggacugguuccuguggaucuccuucgccaucagcugcuuccugcucugcguggcccugcugggcuucaucaugugggcgugccagaaggggaacauccggugcaacaucugcaucuga

SEQ ID NO: 66325 - RNA, 1701 nt, Artificial Sequence
  derived and/or modified sequence opt1 from hemagglutinin__InfluenzaA__ADK87306
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccgccgagcugguccagagcuccagcaccggggagaucugcgacagcccccaccagauccucgacggcaagaacugcacccugaucgacgcccugcucggggacccccagugcgacggcuuccagaacaagaagugggaccuguucgugggccgcuccaaggcguacuccaacugcuaccccuacgacgugccggacuacgccagccugcggucccucgucgccagcuccgggacccuggaguucaacaacgagagcuucaacuggacgggcgugacccagaacgggaccuccagcgccugcauccgccgguccaagaacagcuucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcggccggaucaccguguccaccaagcgcagccagcagacggccaucccgaacaucggcagccggccccgcgugcggaacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcgcccaucggcaagugcaacagcgagugcaucacccccaacggguccauccccaacgacaagccguuccagaacgugaaccgcaucacguacggcgccugcccccgguacgugaagcagaacacccugaagcucgccaccgggguccgcaacgugcccgagaagcagacccggggcaucuucggggccaucgccggcuucaucgagaacggcugggaggggaugguggacggcugguacggguuccgccaccagaacagcgagggccgggggcaggcggccgaccugaaguccacgcaggccgccauggaccagaucaacggcaagcugaaccgccucaucggcaagaccaacgagaagcugcaccagaccgagaaggaguucagcgaggucgaggggcggauccaggaccuggagaaguacguggaggacaccaagaucgaccucugguccuacaacgccgagcugcugguggcgcucgagagccagcacacgaucgaccugaccgacuccgagaugaacaagcuguucgagaagaccaagaagcagcuccgcgagaacgccgaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcguggcgcuccugggguucaucaugugggccugccagaagggcaacauccggugcaacaucugcaucuga

SEQ ID NO: 66326 - RNA, 1701 nt, Artificial Sequence
  derived and/or modified sequence opt1 from hemagglutinin__InfluenzaA__ADK87308
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcuccggguggcccugcugggcuucaucaugugggcgugccagaaggggaacauccgcugcaacaucugcaucuga

SEQ ID NO: 66327 - RNA, 1701 nt, Artificial Sequence
  derived and/or modified sequence opt1 from hemagglutinin__InfluenzaA__ADK87309
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccuguccggcuucaucaugugggcgugccagaaggggaacauccggugcaacaucugcaucuga

SEQ ID NO: 66328 - RNA, 1701 nt, Artificial Sequence
  derived and/or modified sequence opt1 from hemagglutinin__InfluenzaA__ADK87310
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccgggagcuggcccaaccacgacccgaacaagggcgucaccgccgccugcccccacgccggggcgaaguccuucuacaagaaccugaucuggcucgugaagaagggcaacagcuaccccaagcuguccaagagcuacaucaacgacaaggggaaggaggugcugguccucuggggcauccaccaccccuccaccagcgccgaccagcagagccuguaccagaacgccgacgccuacguguucgugggcacgucccgguacagcaagaaguucaagccggagaucgccauccgccccaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgccggugcacgacugcaacacgaccugccagacccccaagggggccaucaacaccucccugcccuuccagaacauccaccccaucaccaucggcaagugcccgaaguacgucaagagcaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcucccuggugcucguggucagccugggcgccaucagcuucuggaugugcuccaacggcagccugcagugccggaucugcaucuga

SEQ ID NO: 66329 - RNA, 1701 nt, Artificial Sequence
  derived and/or modified sequence opt1 from hemagglutinin__InfluenzaA__ADK87311
augaaggccauccuggugguccuccuguacaccuucgccaccgcgaacgccgacacgcugugcaucggcuaccacgccgacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccggccagcagagccuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccuccccgcccuuccagaacauccaccccaucaccaucggcaagugccccaaguacgucaagagcaccaagcugcgccuggcgaccgggcuccggaacgugcccuccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccuggacaucuggaccuacaacgccgagcuccuggugcugcucgagaacgagcgcacccuggacuaccacgacagcaacgugaagaaccuguacgagaagguccggucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcuggagagcacccggaucuaccagauccucgcgaucuacuccaccgucgccagcagccuggugcugguggucucccucggcgccaucagcuucuggaugugcuccaacggcagccugcagugccgcaucugcaucuga

SEQ ID NO: 66330 - RNA, 1701 nt, Artificial Sequence
  derived and/or modified sequence opt1 from hemagglutinin__InfluenzaA__ADK87313
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucgccguguccaccaagcgcagccagcagacggccaucccgaacaucggcagccggccccgcgugcggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcgcccaucggcaagugcaacagcggcugcaucacccccaacggguccauccccaacgacaagccguuccagaacgugaaccgcaucacguacggcgccugcccccgguacgugaagcagaacacccugaagcuggccaccgggaugcgcaacguccccgagaagcagacccggggcaucuucggggccaucgccggcuucaucgagaacggcugggaggggaugguggacggcugguacggguuccgccaccagaacagcgagggccgggggcaggcggccgaccucaaguccacgcaggccgccaucgaccagaucaacggcaagcugaaccgccugaucggcaagaccaacgagaaguuccaccagaucgagaaggaguucagcgagguggaggggcggauccaggaccucgagaaguacgucgaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggcuacaaggacugguuccuguggaucuccuucgccaucagcugcuuccugcucugcguggcgcugcugggguucaucaugugggccugccagaagggcaacauccggugcaacaucugcaucuga

SEQ ID NO: 66331 - RNA, 1701 nt, Artificial Sequence
  derived and/or modified sequence opt1 from hemagglutinin__InfluenzaA__ADK87315
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagccccuggccgaaccacgaccccaacaagggggucaccgccgccugcccccacgccggcgcgaaguccuucuacaagaaccugaucuggcucgugaagaaggggaacagcuaccccaagcuguccaagagcuacaucaacgacaagggcaaggaggugcugguccucugggggauccaccacccguccaccagcgccgaccagcagagccuguaccagaacgccgacgccuacguguucgugggcacgucccgguacagcaagaaguucaagcccgagaucgccauccgccccaagguccgggaccaggagggccgcaugaacuacuacuggacccugguggagcccggggacaagaucaccuucgaggcgaccggcaaccucguggucccgcgguacgccuucgccauggagcgcaacgccggguccggcaucaucaucagcgacacgcccgugcacgacugcaacacgaccugccagacccccaagggcgccaucaacaccucccugcccuuccagaacauccacccgaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggagagcaaccaccuggagacccgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacuccacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66332 - RNA, 1701 nt, Artificial Sequence; identical to SEQ ID NO: 64475
  derived and/or modified sequence opt1 from hemagglutinin__InfluenzaA__ADK87317

SEQ ID NO: 66333 - RNA, 1701 nt, Artificial Sequence
  derived and/or modified sequence opt1 from hemagglutinin__InfluenzaA__ADK87319
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccgagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccggauccuggcgaucuacagcaccgucgccuccagccuggugcucguggucagccugggggccaucuccuucuggaugugcagcaacggcucccugcagugccgcaucugcaucuga

SEQ ID NO: 66334 - RNA, 1701 nt, Artificial Sequence
  derived and/or modified sequence opt1 from hemagglutinin__InfluenzaA__ADK87321
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcaugcgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcagaccgccaucccgaacaucggcagccggccccgcgugcggaacauccccucccgcaucagcgucuacuggaccaucgugaagcccggcgacauccugcugaucaacuccaccgggaaccucaucgccccgcggggcuacuucaagauccgcagcgggaaguccagcaucaugcgguccgacgccagcaucggcaagugcaacuccggcugcaucacgcccaacgggagcauccccaacgacaagcccuuccagaacgugaaccgcaucaccuacggcgcgugcccgcgguacgucaagcagaacacccugaagcuggccaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguuccccgaggucgaggggcggauccaggaccucgagaaguacguggaggacaccaagaucgaccugugguccuacaacgccgagccccugguggcccucgagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcugaaguccggcuacaaggacugguuccucuggaucuccuucgccaucagcugcuuccugcugugcguggcccuccugggguucaucaugugggcgugccagaagggcaacauccggugcaacaucugcaucuga

SEQ ID NO: 66335 - RNA, 1701 nt, Artificial Sequence
  derived and/or modified sequence opt1 from hemagglutinin__InfluenzaA__ADK87323
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugggcaacauccccucccggaucagcaucuacuggaccaucgucaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgcgugcccccgcuacgugaagcagaacacccugaagcucgccaccgggaugcggaacguccccgagaagcagacgcgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggcgugccagaagggcaacauccgcugcaacaucugcaucuga

SEQ ID NO: 66336 - RNA, 1701 nt, Artificial Sequence
  derived and/or modified sequence opt1 from hemagglutinin__InfluenzaA__ADK87325
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccggcacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 66337 - RNA, 1701 nt, Artificial Sequence
  derived and/or modified sequence opt1 from hemagglutinin__InfluenzaA__ADK87326
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcugcaaggacuggauccuguggaucuccuucgccaucagcugcuuccuccugugcguggcccugcucggcuucacgaugugggcgugccagaaggggaacauccggugcaacaucugcaucuga

SEQ ID NO: 66338 - RNA, 1701 nt, Artificial Sequence
  derived and/or modified sequence opt1 from hemagglutinin__InfluenzaA__ADK87328
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagagcgccaucaacaccucccugcccuuccagaacauccaccccaucaccaucggcaagugcccgaaguacgucaagagcaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 66339 - RNA, 1701 nt, Artificial Sequence
  derived and/or modified sequence opt1 from hemagglutinin__InfluenzaA__ADK87334
augaagaccaucaucgcccugagcuacauccucugccugguguucgcccagaagcugcccggcaacgacaacuccaccgcgacgcucugccuggggcaccacgccgucccgaacggcaccaucgugaagaccaucaccagcgaccagaucgaggugacgaacgccaccgagcugguccaguccagcuccaccggggagaucugcgacagcccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagcaagcugaacuggcucacgcaccugaacuucaaguaccccgcccugaacgugaccaugcccaacaacgagcaguucgacaagcucuacaucuggggcguccgccaccccgggaccgacaaggaccagaucuuccuguacgcgcaggccuccgggcggaucaccgugagcacgaagcgcagccagcagaccgugaucccgaacaucggcucccggccccgcguccggaacauccccagccgcaucuccaccuacuggaccaucgugaagcccggcgacauccugcucaucaacagcacggggaaccugaucgccccgcggggcuacuucaagauccgcuccggcaagagcuccaucaugcggagcgacacccccaucgggaagugcaacuccgagugcaucacccccaacggcagcauccccaacgacaagccguuccagaacgugaaccgcaucaccuacggggccugcccccgguacgucaagcagaacacgcugaagcucgccaccggcaugcgcaacgugcccgagaagcagacccgggggaucuucggcgcgaucgccggguucaucgagaacggcugggagggcaugguggacgggugguacggcuuccgccaccagaacuccgaggggcggggccaggccgccgaccucaagagcacccaggccgcgaucgaccagaucaacgggaagcugaaccgccugaucggcaagacgaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66340 - RNA, 1701 nt, Artificial Sequence
  derived and/or modified sequence opt1 from hemagglutinin__InfluenzaA__ADK87336
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucuccaagcugaacuggcucacgcaccugaacuucaaguaccccgcccugaacgugaccaugcccaacaacgagcaguucgacaagcucuacaucuggggcguccaccaccccgggaccgaccgcgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacacgcccaucggcaagagcaacuccgagugcaucacccccaacggcagcauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacuccgaggggcggggccaggccgccgaccugaaguccacccaggccgcgaucgaccagaucaacgggaagcugaaccgccucaucggcaagaccaacgagaaguuccaccagaucgagaaggaguucuccgaggucgagggccggauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgcgaggacgccgaggacauggggaacggcugcuucaagaucuaccacaagugcgacaacgccugcaucgggagcauccgcaacggcacguacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66341 - RNA, 1701 nt, Artificial Sequence; identical to SEQ ID NO: 63677
  derived and/or modified sequence opt1 from hemagglutinin__InfluenzaA__ADK87338

SEQ ID NO: 66342 - RNA, 1701 nt, Artificial Sequence
  derived and/or modified sequence opt1 from hemagglutinin__InfluenzaA__ADK90193
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggugguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66343 - RNA, 1701 nt, Artificial Sequence
  derived and/or modified sequence opt1 from hemagglutinin__InfluenzaA__ADK90194
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 66344 - RNA, 1701 nt, Artificial Sequence
  derived and/or modified sequence opt1 from hemagglutinin__InfluenzaA__ADK90195
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66345 - RNA, 1701 nt, Artificial Sequence; identical to SEQ ID NO: 63664
  derived and/or modified sequence opt1 from hemagglutinin__InfluenzaA__ADK90196

SEQ ID NO: 66346 - RNA, 1701 nt, Artificial Sequence
  derived and/or modified sequence opt1 from hemagglutinin__InfluenzaA__ADK90197
augcgcgccauccugggcgugcuccuguacaccuucgccaccgcgaacgccgacacgcugugcaucggguaccacgccaacaacagcaccgacaccgucgacaccgugcucgagaagaacgugacggucacccacuccgugaaccugcuggaggacaagcacaacggcaagcucugcaagcugcgcgggguggcgccccugcaccucggcaagugcaacaucgccggguggauccugggcaacccggagugcgagagccuguccaccgccagcuccuggagcuacaucgucgagaccuccagcuccgacaacggcacgugcuaccccggggacuucaucgacuacgaggagcuccgggagcagcugagcuccgugagcuccuucgagcgguucgagaucuuccccaagaccagcuccuggcccaaccacgacagcaacaagggcgugaccgccgccugcccgcacgccggggcgaaguccuucuacaagaaccugaucuggcucgucaagaagggcaacagcuaccccaagcuguccaagagcuacaucaacgacaaggggaaggaggugcuggugcucuggggcauccaccaccccagcaccuccgccgaccagcagagccuguaccagaacgccgacgccuacgucuucgugggcacgucccgcuacagcaagaaguucaagcccgagaucgccauccggccgaaggugcgcgaccaggaggggcggaugaacuacuacuggacccuggucgagcccggcgacaagaucaccuucgaggcgaccgggaaccucguggugccccgcuacgccuucgccauggagcggaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgcgaggagaucgacggggugaagcucgagagcacccggaucuaccagauccuggcgaucuacuccaccguggccagcagccugguccucguggugucccugggcgccaucagcuucuggaugugcuccaacggcagccugcagugccgcaucugcaucuga

SEQ ID NO: 66347 - RNA, 1701 nt, Artificial Sequence
  derived and/or modified sequence opt1 from hemagglutinin__InfluenzaA__ADK90198
augaaggccauccugggcgugcuccuguacaccuucgccaccgcgaacgccgacacgcugugcaucggguaccacgccaacaacagcaccgacaccgucgacaccgugcucgagaagaacgugacggucacccacuccgugaaccugcuggaggacaagcacaacggcaagcucugcaagcugcgcgggguggcgccccugcaccucggcaagugcaacaucgccggguggauccugggcaacccggagugcgagagccuguccaccgccagcuccuggagcuacaucgucgagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgugaccgccgccugcccgcacgccggggcgaaguccuucuacaagaaccugaucuggcucgucaagaagggcaacagcuaccccaagcuguccaagagcuacaucaacgacaaggggaaggaggugcuggugcucuggggcauccaccaccccagcaccuccgccgaccagcagagccuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 66348 - RNA, 1701 nt, Artificial Sequence; identical to SEQ ID NO: 63677
  derived and/or modified sequence opt1 from hemagglutinin__InfluenzaA__ADK90199

SEQ ID NO: 66349 - RNA, 1701 nt, Artificial Sequence
  derived and/or modified sequence opt1 from hemagglutinin__InfluenzaA__ADK90200
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucgcguucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccgucuacuccaccguggccagcagccuggugcucgucgugucccugggggccaucagcuucuggaugugcuccaacggcagccugcagugccggaucugcaucuga

SEQ ID NO: 66350 - RNA, 1701 nt, Artificial Sequence
  derived and/or modified sequence opt1 from hemagglutinin__InfluenzaA__ADK90201
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccguccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66351 - RNA, 1701 nt, Artificial Sequence
  derived and/or modified sequence opt1 from hemagglutinin__InfluenzaA__ADK90202
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugagcaccgcguccagcugguccuacaucguggagaccagcuccagcgacaacggcacgugcuaccccggcgacuucaucgacuacgaggagcuccgggagcagcuguccagcguguccagcuucgagcgccuggagaucuuccccaagaccuccagcuggccgaaccacgacuccaacaagggggucaccgccgccugcccccacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgccggugcacgacugcaacacgaccugccagacccccaacggcgccaucaacaccagccugcccuuccagaacauccaccccaucaccaucgggaagugcccgaaguacgugaaguccaccaagcuccggcuggcgaccggccugcgcaacguccccagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 66352 - RNA, 1701 nt, Artificial Sequence; identical to SEQ ID NO: 63857
  derived and/or modified sequence opt1 from hemagglutinin__InfluenzaA__ADK90203

SEQ ID NO: 66353 - RNA, 1701 nt, Artificial Sequence; identical to SEQ ID NO: 64778
  derived and/or modified sequence opt1 from hemagglutinin__InfluenzaA__ADK90204

SEQ ID NO: 66354 - RNA, 1701 nt, Artificial Sequence
  derived and/or modified sequence opt1 from hemagglutinin__InfluenzaA__ADK94191
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccagcgggcggaucaccguguccacgaagcgcagccagcagaccgucaucccgaacaucggcagccggccccgcgugcggaacauccccucccgcgugagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66355 - RNA, 1701 nt, Artificial Sequence
  derived and/or modified sequence opt1 from hemagglutinin__InfluenzaA__ADK94202
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66356 - RNA, 1701 nt, Artificial Sequence; identical to SEQ ID NO: 63442
  derived and/or modified sequence opt1 from hemagglutinin__InfluenzaA__ADK94213

SEQ ID NO: 66357 - RNA, 1701 nt, Artificial Sequence; identical to SEQ ID NO: 64621
  derived and/or modified sequence opt1 from hemagglutinin__InfluenzaA__ADK94224

SEQ ID NO: 66358 - RNA, 1701 nt, Artificial Sequence
  derived and/or modified sequence opt1 from hemagglutinin__InfluenzaA__ADK94257
auggagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagagcacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66359 - RNA, 1701 nt, Artificial Sequence
  derived and/or modified sequence opt1 from hemagglutinin__InfluenzaA__ADK94268
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagagcacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66360 - RNA, 1701 nt, Artificial Sequence
  derived and/or modified sequence opt1 from hemagglutinin__InfluenzaA__ADK94279
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66361 - RNA, 1701 nt, Artificial Sequence; identical to SEQ ID NO: 64621
  derived and/or modified sequence opt1 from hemagglutinin__InfluenzaA__ADK94290

SEQ ID NO: 66362 - RNA, 1701 nt, Artificial Sequence; identical to SEQ ID NO: 64621
  derived and/or modified sequence opt1 from hemagglutinin__InfluenzaA__ADK94301

SEQ ID NO: 66363 - RNA, 1701 nt, Artificial Sequence
  derived and/or modified sequence opt1 from hemagglutinin__InfluenzaA__ADK94323
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66364 - RNA, 1701 nt, Artificial Sequence; identical to SEQ ID NO: 66354
  derived and/or modified sequence opt1 from hemagglutinin__InfluenzaA__ADK94441

SEQ ID NO: 66365 - RNA, 1701 nt, Artificial Sequence
  derived and/or modified sequence opt1 from hemagglutinin__InfluenzaA__ADK94476
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcgcgcaccaccccgggaccgacaaggaccagaucuuccuguacgcccaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 66366 - RNA, 1701 nt, Artificial Sequence; identical to SEQ ID NO: 64621
  derived and/or modified sequence opt1 from hemagglutinin__InfluenzaA__ADK94487

SEQ ID NO: 66367 - RNA, 1701 nt, Artificial Sequence
  derived and/or modified sequence opt1 from hemagglutinin__InfluenzaA__ADK94498
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 66368 - RNA, 1701 nt, Artificial Sequence
  derived and/or modified sequence opt1 from hemagglutinin__InfluenzaA__ADK94509
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacaucaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 66369 - RNA, 1701 nt, Artificial Sequence
  derived and/or modified sequence opt1 from hemagglutinin__InfluenzaA__ADK94520
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcuguacaucuggggcgugcaccaccccgggaccgacaacgaccagaucuuccuguacgcgcaggccagcgggcgcaucaccgucuccacgaagcggagccagcagaccgugaucccgaacaucggcagccgcccccgggugcgcaacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacaucaagugcaacaucugcaucuga

SEQ ID NO: 66370 - RNA, 1701 nt, Artificial Sequence; identical to SEQ ID NO: 64621
  derived and/or modified sequence opt1 from hemagglutinin__InfluenzaA__ADK94531

SEQ ID NO: 66371 - RNA, 1701 nt, Artificial Sequence; identical to SEQ ID NO: 63442
  derived and/or modified sequence opt1 from hemagglutinin__InfluenzaA__ADK94542

SEQ ID NO: 66372 - RNA, 1701 nt, Artificial Sequence
  derived and/or modified sequence opt1 from hemagglutinin__InfluenzaA__ADK94553
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagagcacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcaacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66373 - RNA, 1701 nt, Artificial Sequence; identical to SEQ ID NO: 64621
  derived and/or modified sequence opt1 from hemagglutinin__InfluenzaA__ADK94564

SEQ ID NO: 66374 - RNA, 1701 nt, Artificial Sequence
  derived and/or modified sequence opt1 from hemagglutinin__InfluenzaA__ADK98501
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgagaccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagagcaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 66375 - RNA, 1701 nt, Artificial Sequence
  derived and/or modified sequence opt1 from hemagglutinin__InfluenzaA__ADK98503
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacguggacgccuacguguucgucggcacgagccgguacuccaagaaguucaagccggagaucgccauccgccccaaggugcgggaccaggagggccgcaugaacuacuacuggacccugguggagcccggggacaagaucaccuucgaggccaccggcaaccucgucgugccccgguacgcguucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgucaaguccaccaagcugcggcucgccaccggccugcgcaacgugcccagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggucaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcguccagccuggugcucgucgugagccugggggccaucuccuucuggaugugcagcaacggcucccugcagugccggaucugcaucuga

SEQ ID NO: 66376 - RNA, 1701 nt, Artificial Sequence; identical to SEQ ID NO: 66359
  derived and/or modified sequence opt1 from hemagglutinin__InfluenzaA__ADK98623

SEQ ID NO: 66377 - RNA, 1701 nt, Artificial Sequence; identical to SEQ ID NO: 63442
  derived and/or modified sequence opt1 from hemagglutinin__InfluenzaA__ADK98634

SEQ ID NO: 66378 - RNA, 1701 nt, Artificial Sequence; identical to SEQ ID NO: 63442
  derived and/or modified sequence opt1 from hemagglutinin__InfluenzaA__ADK98645

SEQ ID NO: 66379 - RNA, 1701 nt, Artificial Sequence; identical to SEQ ID NO: 66305
  derived and/or modified sequence opt1 from hemagglutinin__InfluenzaA__ADK98656

SEQ ID NO: 66380 - RNA, 1701 nt, Artificial Sequence; identical to SEQ ID NO: 66372
  derived and/or modified sequence opt1 from hemagglutinin__InfluenzaA__ADK98667

SEQ ID NO: 66381 - RNA, 1701 nt, Artificial Sequence
  derived and/or modified sequence opt1 from hemagglutinin__InfluenzaA__ADK98678
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcagaacggcuccauccccaacgacaagcccuuccagaacgugaaccgcaucaccuacggggccugcccgcgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66382 - RNA, 1701 nt, Artificial Sequence; identical to SEQ ID NO: 63442
  derived and/or modified sequence opt1 from hemagglutinin__InfluenzaA__ADK98689

SEQ ID NO: 66383 - RNA, 1701 nt, Artificial Sequence; identical to SEQ ID NO: 63442
  derived and/or modified sequence opt1 from hemagglutinin__InfluenzaA__ADK98700

SEQ ID NO: 66384 - RNA, 1701 nt, Artificial Sequence; identical to SEQ ID NO: 63442
  derived and/or modified sequence opt1 from hemagglutinin__InfluenzaA__ADK98711

SEQ ID NO: 66385 - RNA, 1701 nt, Artificial Sequence
  derived and/or modified sequence opt1 from hemagglutinin__InfluenzaA__ADK98722
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagggcagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 66386 - RNA, 1701 nt, Artificial Sequence; identical to SEQ ID NO: 66359
  derived and/or modified sequence opt1 from hemagglutinin__InfluenzaA__ADK98733

SEQ ID NO: 66387 - RNA, 1701 nt, Artificial Sequence; identical to SEQ ID NO: 63442
  derived and/or modified sequence opt1 from hemagglutinin__InfluenzaA__ADK98744

SEQ ID NO: 66388 - RNA, 1701 nt, Artificial Sequence; identical to SEQ ID NO: 63442
  derived and/or modified sequence opt1 from hemagglutinin__InfluenzaA__ADK98777

SEQ ID NO: 66389 - RNA, 1701 nt, Artificial Sequence; identical to SEQ ID NO: 63442
  derived and/or modified sequence opt1 from hemagglutinin__InfluenzaA__ADK98788

SEQ ID NO: 66390 - RNA, 1701 nt, Artificial Sequence; identical to SEQ ID NO: 64621
  derived and/or modified sequence opt1 from hemagglutinin__InfluenzaA__ADK98799

SEQ ID NO: 66391 - RNA, 1701 nt, Artificial Sequence
  derived and/or modified sequence opt1 from hemagglutinin__InfluenzaA__ADK98810
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaccuuccuguacgcgcaggccagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacaacgucuaccgggacgaggcccucaacaaccgcuuccagaucaaggagguggagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 66392 - RNA, 1701 nt, Artificial Sequence
  derived and/or modified sequence opt1 from hemagglutinin__InfluenzaA__ADK98821
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagacccgcaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggcgugccagaaggggaacauccgcugcaacaucugcaucuga

SEQ ID NO: 66393 - RNA, 1701 nt, Artificial Sequence; identical to SEQ ID NO: 63442
  derived and/or modified sequence opt1 from hemagglutinin__InfluenzaA__ADK98832

SEQ ID NO: 66394 - RNA, 1701 nt, Artificial Sequence; identical to SEQ ID NO: 66372
  derived and/or modified sequence opt1 from hemagglutinin__InfluenzaA__ADK98843

SEQ ID NO: 66395 - RNA, 1701 nt, Artificial Sequence
  derived and/or modified sequence opt1 from hemagglutinin__InfluenzaA__ADK98854
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcuccaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcccaggcgagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacagcgaggggcggggccaggccgccgaccugaaguccacccaggccgcgaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcacguacgaccacgacgucuaccgggacgaggcgcucaacaaccgcuuccagaucaaggggguggagcugaagcccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66396 - RNA, 1701 nt, Artificial Sequence
  derived and/or modified sequence opt1 from hemagglutinin__InfluenzaA__ADK98865
augaagaccaucaucgcccugagcuacauccucugccugguguucgcccagaagcugcccggcuccgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacgacuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggcgugacccagaacgggaccagcuccgccugcauccgccggagcuccaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccagcggccgcaucaccgugagcacgaagcggucccagcagaccgugaucccgaacaucgggagccgcccccggguccgcaacauccccucccggaucagcaucuacuggaccaucgugaagcccggcgacauccugcucaucaacuccaccggcaaccugaucgccccgcgcggguacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacgggugggagggcaugguggacggcugguacggguuccggcaccagaacagcgagggccgcgggcaggccgccgaccugaaguccacccaggcggccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcucaagagcggguacaaggacuggauccuguggaucuccuucgccaucagcugcuuccugcugugcguggcccugcucggcuucaucaugugggccugccagaagggcaacauccgcugcaacaucugcaucuga

SEQ ID NO: 66397 - RNA, 1701 nt, Artificial Sequence
  derived and/or modified sequence opt1 from hemagglutinin__InfluenzaA__ADK98876
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagccgccugaacuggcucacgcaccugaacuucaaguaccccgcccugaacgugaccaugcccaacaacgggcaguucgacaagcucuacaucuggggcguccaccaccccgggaccgacaaggaccagaucuuccuguacgcgcaggccuccggccggaucaccgugagcacgaagcgcucccagcagaccgugaucccgaacaucggcagccggccccgcguccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 66398 - RNA, 1701 nt, Artificial Sequence; identical to SEQ ID NO: 66372
  derived and/or modified sequence opt1 from hemagglutinin__InfluenzaA__ADK98887

SEQ ID NO: 66399 - RNA, 1701 nt, Artificial Sequence; identical to SEQ ID NO: 63442
  derived and/or modified sequence opt1 from hemagglutinin__InfluenzaA__ADK98898

SEQ ID NO: 66400 - RNA, 1701 nt, Artificial Sequence
  derived and/or modified sequence opt1 from hemagglutinin__InfluenzaA__ADK98909
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66401 - RNA, 1701 nt, Artificial Sequence
  derived and/or modified sequence opt1 from hemagglutinin__InfluenzaA__ADK98920
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcggcaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcagaccgugaucccgaacaucggcagccggccccgcguccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcaguccacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 66402 - RNA, 1701 nt, Artificial Sequence; identical to SEQ ID NO: 63442
  derived and/or modified sequence opt1 from hemagglutinin__InfluenzaA__ADK98931

SEQ ID NO: 66403 - RNA, 1701 nt, Artificial Sequence
  derived and/or modified sequence opt1 from hemagglutinin__InfluenzaA__ADK98942
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucagcaacaucggcucccggccgcgcguccggaacauccccagccgcaucuccaucuacuggaccaucgugaagcccggcgacauccugcucaucaacagcaccgggaaccugaucgcgccccggggcuacuucaagauccgcuccgggaaguccuccaucaugcggagcgacgccccgaucggcaagugcaacuccgagugcaucacgcccaacggcagcauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66404 - RNA, 1701 nt, Artificial Sequence
  derived and/or modified sequence opt1 from hemagglutinin__InfluenzaA__ADK98953
augaagaccaucaucgcccugagcuacaugcucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66405 - RNA, 1701 nt, Artificial Sequence; identical to SEQ ID NO: 63442
  derived and/or modified sequence opt1 from hemagglutinin__InfluenzaA__ADK98964

SEQ ID NO: 66406 - RNA, 1701 nt, Artificial Sequence; identical to SEQ ID NO: 66359
  derived and/or modified sequence opt1 from hemagglutinin__InfluenzaA__ADK98975

SEQ ID NO: 66407 - RNA, 1701 nt, Artificial Sequence; identical to SEQ ID NO: 66404
  derived and/or modified sequence opt1 from hemagglutinin__InfluenzaA__ADK98986

SEQ ID NO: 66408 - RNA, 1701 nt, Artificial Sequence; identical to SEQ ID NO: 64621
  derived and/or modified sequence opt1 from hemagglutinin__InfluenzaA__ADK98997

SEQ ID NO: 66409 - RNA, 1701 nt, Artificial Sequence; identical to SEQ ID NO: 66404
  derived and/or modified sequence opt1 from hemagglutinin__InfluenzaA__ADK99008

SEQ ID NO: 66410 - RNA, 1701 nt, Artificial Sequence
  derived and/or modified sequence opt1 from hemagglutinin__InfluenzaA__ADK99030
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcgguucgacaagcucuacaucuggggcguccaccaccccgggaccgacaaggaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 66411 - RNA, 1701 nt, Artificial Sequence
  derived and/or modified sequence opt1 from hemagglutinin__InfluenzaA__ADK99041
augaagaccaucaucgcccugagcuacauccucugccugguguucgcccagaagcugcccggcaacgacaacuccaccgcgacgcucugccuggggcaccacgccgucccgaacggcaccaucgugaagaccaucgccaacgaccagaucgaggugaccaacgccacggagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcguacuccaacugcuaccccuacgacgugccggacuacgccagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 66412 - RNA, 1701 nt, Artificial Sequence; identical to SEQ ID NO: 66359
  derived and/or modified sequence opt1 from hemagglutinin__InfluenzaA__ADK99063

SEQ ID NO: 66413 - RNA, 1701 nt, Artificial Sequence; identical to SEQ ID NO: 63442
  derived and/or modified sequence opt1 from hemagglutinin__InfluenzaA__ADK99085

SEQ ID NO: 66414 - RNA, 1701 nt, Artificial Sequence; identical to SEQ ID NO: 63442
  derived and/or modified sequence opt1 from hemagglutinin__InfluenzaA__ADK99096

SEQ ID NO: 66415 - RNA, 1701 nt, Artificial Sequence; identical to SEQ ID NO: 63442
  derived and/or modified sequence opt1 from hemagglutinin__InfluenzaA__ADK99107

SEQ ID NO: 66416 - RNA, 1701 nt, Artificial Sequence
  derived and/or modified sequence opt1 from hemagglutinin__InfluenzaA__ADK99118
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacaucccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcaguccacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcaacaacgcgugcaucggguccauccgcaacggcaccuacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 66417 - RNA, 1701 nt, Artificial Sequence
  derived and/or modified sequence opt1 from hemagglutinin__InfluenzaA__ADK99129
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacaugaccaugcccaacaacgagcaguucgacaagcucuacaucuggggcgugcaccaccccgggaccgacaaggaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagagcacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcaacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66418 - RNA, 1701 nt, Artificial Sequence; identical to SEQ ID NO: 66359
  derived and/or modified sequence opt1 from hemagglutinin__InfluenzaA__ADK99140

SEQ ID NO: 66419 - RNA, 1701 nt, Artificial Sequence
  derived and/or modified sequence opt1 from hemagglutinin__InfluenzaA__ADK99151
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggccugcagaacaagaagugggaccuguucguggagcgcagcaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaagaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccuccugaucaacuccaccgggaaccugaucgccccgcggggcuacuucaagauccgcagcgggaaguccagcaucaugcgguccgacgcccccaucggcaagugcaacagcaagugcaucacgcccaacggcuccauccccaacgacaagccguuccagaacgugaaccgcaucaccuacggggcgugcccccgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 66420 - RNA, 1701 nt, Artificial Sequence; identical to SEQ ID NO: 66359
  derived and/or modified sequence opt1 from hemagglutinin__InfluenzaA__ADK99162

SEQ ID NO: 66421 - RNA, 1701 nt, Artificial Sequence
  derived and/or modified sequence opt1 from hemagglutinin__InfluenzaA__ADK99173
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugauccagagcuccagcaccggggagaucugcgacagcccccaccagauccucgacggcgagaacugcacccugaucgacgcccugcucggggacccccagugcgacggccugcagaacaagaagugggaccuguucgucgagcgcagcaaggccuacuccaacugcuaccccuacgacgugccggacuacgcgagccuccggucccugguggccagcuccggcacgcuggaguucaacaacgagagcuucaacuggaccggggucacccagaacggcaccuccagcgccugcauccgccgguccaacaacagcuucuucucccgccucaacuggcugacgcaccugaaguucaaguaccccgcccucaacgugaccaugcccaacaacgagcaguucgacaagcuguacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccuccugaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccucaagcuggcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 66422 - RNA, 1701 nt, Artificial Sequence
  derived and/or modified sequence opt1 from hemagglutinin__InfluenzaA__ADK99184
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcaacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66423 - RNA, 1701 nt, Artificial Sequence; identical to SEQ ID NO: 63442
  derived and/or modified sequence opt1 from hemagglutinin__InfluenzaA__ADK99195

SEQ ID NO: 66424 - RNA, 1701 nt, Artificial Sequence
  derived and/or modified sequence opt1 from hemagglutinin__InfluenzaA__ADK99206
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccggggagaucugcgacagcccccaccagauccucgacggcaagaacugcacccugaucgacgcccugcucggggacccccagugcgacggcuuccagaacaagaagugggaccuguucguggagcgcuccaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccagcgggcggaucaccguguccacgaagcgcagccagcagaccgucaucccgaacaucggcagccggccccgcgugcggaacauccccucccgcgugagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccuggugagccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcgcucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66425 - RNA, 1701 nt, Artificial Sequence; identical to SEQ ID NO: 66359
  derived and/or modified sequence opt1 from hemagglutinin__InfluenzaA__ADK99217

SEQ ID NO: 66426 - RNA, 1701 nt, Artificial Sequence; identical to SEQ ID NO: 66359
  derived and/or modified sequence opt1 from hemagglutinin__InfluenzaA__ADK99228

SEQ ID NO: 66427 - RNA, 1701 nt, Artificial Sequence
  derived and/or modified sequence opt1 from hemagglutinin__InfluenzaA__ADK99239
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66428 - RNA, 1701 nt, Artificial Sequence
  derived and/or modified sequence opt1 from hemagglutinin__InfluenzaA__ADK99250
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggacaucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 66429 - RNA, 1701 nt, Artificial Sequence; identical to SEQ ID NO: 66359
  derived and/or modified sequence opt1 from hemagglutinin__InfluenzaA__ADK99261

SEQ ID NO: 66430 - RNA, 1701 nt, Artificial Sequence
  derived and/or modified sequence opt1 from hemagglutinin__InfluenzaA__ADK99283
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagcgcuacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 66431 - RNA, 1701 nt, Artificial Sequence
  derived and/or modified sequence opt1 from hemagglutinin__InfluenzaA__ADK99294
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccaggacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 66432 - RNA, 1701 nt, Artificial Sequence; identical to SEQ ID NO: 63442
  derived and/or modified sequence opt1 from hemagglutinin__InfluenzaA__ADK99305

SEQ ID NO: 66433 - RNA, 1701 nt, Artificial Sequence; identical to SEQ ID NO: 63442
  derived and/or modified sequence opt1 from hemagglutinin__InfluenzaA__ADL27989

SEQ ID NO: 66434 - RNA, 1701 nt, Artificial Sequence
  derived and/or modified sequence opt1 from hemagglutinin__InfluenzaA__ADL28000
augaagaccaucaucgcccugagcuacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgagcggaucaccguguccacgaagcgcagccagcagaccgugaucccgaacaucgggagccggccccgcguccggaacauccccucccgcaucagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcgagugcaucacgcccaacggcuccauccccaacgacaagccguuccagaacgugaaccgcaucaccuacggcgccugcccccgguacgucaagcagagcacccugaagcucgcgaccgggaugcgcaacgugcccgagaagcagacgcggggcaucuucggggccaucgccggcuucaucgagaacgggugggagggcaugguggacggcugguacggguuccgccaccagaacuccgagggccgggggcaggccgccgaccugaaguccacccaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaagggcaacauccggugcaacaucugcaucuga

SEQ ID NO: 66435 - RNA, 1701 nt, Artificial Sequence
  derived and/or modified sequence opt1 from hemagglutinin__InfluenzaA__ADL28011
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgcgccggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 66436 - RNA, 1701 nt, Artificial Sequence; identical to SEQ ID NO: 66359
  derived and/or modified sequence opt1 from hemagglutinin__InfluenzaA__ADL28022

SEQ ID NO: 66437 - RNA, 1701 nt, Artificial Sequence; identical to SEQ ID NO: 63442
  derived and/or modified sequence opt1 from hemagglutinin__InfluenzaA__ADL28033

SEQ ID NO: 66438 - RNA, 1701 nt, Artificial Sequence; identical to SEQ ID NO: 64621
  derived and/or modified sequence opt1 from hemagglutinin__InfluenzaA__ADL28044

SEQ ID NO: 66439 - RNA, 1701 nt, Artificial Sequence
  derived and/or modified sequence opt1 from hemagglutinin__InfluenzaA__ADL28055
augaagaccaucguggcccugagcuacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 66440 - RNA, 1701 nt, Artificial Sequence; identical to SEQ ID NO: 63442
  derived and/or modified sequence opt1 from hemagglutinin__InfluenzaA__ADL28066

SEQ ID NO: 66441 - RNA, 1701 nt, Artificial Sequence; identical to SEQ ID NO: 66359
  derived and/or modified sequence opt1 from hemagglutinin__InfluenzaA__ADL28077

SEQ ID NO: 66442 - RNA, 1701 nt, Artificial Sequence
  derived and/or modified sequence opt1 from hemagglutinin__InfluenzaA__ADL28088
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacagccaggcguccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggcggggccaggccgccgaccucaagagcacccaggccgcgaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66443 - RNA, 1701 nt, Artificial Sequence; identical to SEQ ID NO: 63442
  derived and/or modified sequence opt1 from hemagglutinin__InfluenzaA__ADL28099

SEQ ID NO: 66444 - RNA, 1701 nt, Artificial Sequence
  derived and/or modified sequence opt1 from hemagglutinin__InfluenzaA__ADL28110
augaagaccaucaucgcccugagcuacauccucugccugguguucgcccagaagcugcccggcaacgacaacuccaccgcgacgcucugcaucgggcaccacgccgucccgaacggcaccaucgugaagaccaucaccaacgaccagaucgaggugacgaacgccaccgagcugguccagaacagcuccaccggggagaucugcgacagcccccaccagauccuggacggcaagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaagaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcagaccgccaucccgaacaucggcagccggccccgcgugcggaacauccccagccgcaucuccaucuacuggaccaucgucaagcccggcgacauccugcugaucaacagcaccgggaaccucaucgccccgcggggcuacuucaagauccgcuccggcaagagcuccaucaugcggagcgacgcccccaucgacaagugcaacuccgagugcaucacgcccaacgggagcauccccaacgacaagccguuccagaacgugaaccgcaucaccuacggcgcgugcccccgguacgugaagcagaacacccugaagcuggccaccgggaugcgcaacguccccgagaagcagacgcggggcaucuucggggccaucgccggcuucaucgagaacgggugggagggcaugguggacggcugguacggguuccgccaccagaacuccgagggccgggggcaggccgcggaccucaagagcacccaggccgccaucgaccagaucaacggcaagcugaaccgccugaucgggaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcucaaguccggguacaaggacuggauccuguggaucagcuucgccaucuccugcuuccugcucugcguggcccugcugggcuucaucaugugggcgugccagaagggcaacauccggugcaacaucugcaucuga

SEQ ID NO: 66445 - RNA, 1701 nt, Artificial Sequence
  derived and/or modified sequence opt1 from hemagglutinin__InfluenzaA__ADL28126
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugaaccagaacggcaccuccagcgccugcauccgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66446 - RNA, 1701 nt, Artificial Sequence
  derived and/or modified sequence opt1 from hemagglutinin__InfluenzaA__ADL28137
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacggcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 66447 - RNA, 1701 nt, Artificial Sequence; identical to SEQ ID NO: 63442
  derived and/or modified sequence opt1 from hemagglutinin__InfluenzaA__ADL28148

SEQ ID NO: 66448 - RNA, 1701 nt, Artificial Sequence; identical to SEQ ID NO: 66359
  derived and/or modified sequence opt1 from hemagglutinin__InfluenzaA__ADL28170

SEQ ID NO: 66449 - RNA, 1701 nt, Artificial Sequence; identical to SEQ ID NO: 63442
  derived and/or modified sequence opt1 from hemagglutinin__InfluenzaA__ADL28181

SEQ ID NO: 66450 - RNA, 1701 nt, Artificial Sequence; identical to SEQ ID NO: 66354
  derived and/or modified sequence opt1 from hemagglutinin__InfluenzaA__ADL28192

SEQ ID NO: 66451 - RNA, 1701 nt, Artificial Sequence; identical to SEQ ID NO: 66360
  derived and/or modified sequence opt1 from hemagglutinin__InfluenzaA__ADL28203

SEQ ID NO: 66452 - RNA, 1701 nt, Artificial Sequence; identical to SEQ ID NO: 64419
  derived and/or modified sequence opt1 from hemagglutinin__InfluenzaA__ADL28214

SEQ ID NO: 66453 - RNA, 1701 nt, Artificial Sequence
  derived and/or modified sequence opt1 from hemagglutinin__InfluenzaA__ADL28225
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacagccaggcguccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggcggggccaggccgccgaccucaagagcacccaggccgcgaucgaccagaucaacgggaagcugaaccgccugaucggcaagaccaacgagaaguuccaccagaucgagaaggaguucuccgaggucgagggccggauccaggaccuggagaaguacguggaggacaccaagacggaccuguggagcuacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcacguacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66454 - RNA, 1701 nt, Artificial Sequence; identical to SEQ ID NO: 66359
  derived and/or modified sequence opt1 from hemagglutinin__InfluenzaA__ADL28236

SEQ ID NO: 66455 - RNA, 1701 nt, Artificial Sequence; identical to SEQ ID NO: 63442
  derived and/or modified sequence opt1 from hemagglutinin__InfluenzaA__ADL28247

SEQ ID NO: 66456 - RNA, 1701 nt, Artificial Sequence; identical to SEQ ID NO: 66372
  derived and/or modified sequence opt1 from hemagglutinin__InfluenzaA__ADL28258

SEQ ID NO: 66457 - RNA, 1701 nt, Artificial Sequence; identical to SEQ ID NO: 63442
  derived and/or modified sequence opt1 from hemagglutinin__InfluenzaA__ADL28370

SEQ ID NO: 66458 - RNA, 1701 nt, Artificial Sequence; identical to SEQ ID NO: 63677
  derived and/or modified sequence opt1 from hemagglutinin__InfluenzaA__ADL29672

SEQ ID NO: 66459 - RNA, 1701 nt, Artificial Sequence; identical to SEQ ID NO: 63919
  derived and/or modified sequence opt1 from hemagglutinin__InfluenzaA__ADL29682

SEQ ID NO: 66460 - RNA, 1701 nt, Artificial Sequence; identical to SEQ ID NO: 63677
  derived and/or modified sequence opt1 from hemagglutinin__InfluenzaA__ADL29692

SEQ ID NO: 66461 - RNA, 1701 nt, Artificial Sequence
  derived and/or modified sequence opt1 from hemagglutinin__InfluenzaA__ADL29702
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggcguccagccugguccucguggugagccugggggccaucuccuucuggaugugcagcaacggcucccugcagugccggaucugcaucuga

SEQ ID NO: 66462 - RNA, 1701 nt, Artificial Sequence; identical to SEQ ID NO: 63677
  derived and/or modified sequence opt1 from hemagglutinin__InfluenzaA__ADL29730

SEQ ID NO: 66463 - RNA, 1701 nt, Artificial Sequence; identical to SEQ ID NO: 63677
  derived and/or modified sequence opt1 from hemagglutinin__InfluenzaA__ADL29740

SEQ ID NO: 66464 - RNA, 1701 nt, Artificial Sequence; identical to SEQ ID NO: 63677
  derived and/or modified sequence opt1 from hemagglutinin__InfluenzaA__ADL29750

SEQ ID NO: 66465 - RNA, 1701 nt, Artificial Sequence
  derived and/or modified sequence opt1 from hemagglutinin__InfluenzaA__ADL29760
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66466 - RNA, 1701 nt, Artificial Sequence; identical to SEQ ID NO: 63677
  derived and/or modified sequence opt1 from hemagglutinin__InfluenzaA__ADL29770

SEQ ID NO: 66467 - RNA, 1701 nt, Artificial Sequence; identical to SEQ ID NO: 65177
  derived and/or modified sequence opt1 from hemagglutinin__InfluenzaA__ADL29780

SEQ ID NO: 66468 - RNA, 1701 nt, Artificial Sequence
  derived and/or modified sequence opt1 from hemagglutinin__InfluenzaA__ADL29879
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagcaaguacuccaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 66469 - RNA, 1701 nt, Artificial Sequence
  derived and/or modified sequence opt1 from hemagglutinin__InfluenzaA__ADL32017
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugccagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 66470 - RNA, 1701 nt, Artificial Sequence
  derived and/or modified sequence opt1 from hemagglutinin__InfluenzaA__ADL32037
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccguggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 66471 - RNA, 1701 nt, Artificial Sequence; identical to SEQ ID NO: 63677
  derived and/or modified sequence opt1 from hemagglutinin__InfluenzaA__ADL32047

SEQ ID NO: 66472 - RNA, 1701 nt, Artificial Sequence
  derived and/or modified sequence opt1 from hemagglutinin__InfluenzaA__ADL32057
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagggccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaggggaccaagcugcggcucgcgaccggccugcgcaacgucccguccauccagagccgggggcuguucggcgccaucgccggcuucaucgagggcggguggacggggaugguggacggcugguacggguaccaccaccagaacgagcagggcuccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggcgccaucagcuucuggaugugcuccaacgggagccugcagugccggaucugcaucuga

SEQ ID NO: 66473 - RNA, 1701 nt, Artificial Sequence; identical to SEQ ID NO: 63677
  derived and/or modified sequence opt1 from hemagglutinin__InfluenzaA__ADL32090

SEQ ID NO: 66474 - RNA, 1701 nt, Artificial Sequence; identical to SEQ ID NO: 63677
  derived and/or modified sequence opt1 from hemagglutinin__InfluenzaA__ADL32114

SEQ ID NO: 66475 - RNA, 1701 nt, Artificial Sequence; identical to SEQ ID NO: 63677
  derived and/or modified sequence opt1 from hemagglutinin__InfluenzaA__ADL32344

SEQ ID NO: 66476 - RNA, 1701 nt, Artificial Sequence; identical to SEQ ID NO: 64124
  derived and/or modified sequence opt1 from hemagglutinin__InfluenzaA__ADL32354

SEQ ID NO: 66477 - RNA, 1701 nt, Artificial Sequence
  derived and/or modified sequence opt1 from hemagglutinin__InfluenzaA__ADL32364
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacacguacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggcguccagccugguccucguggugagccugggggccaucuccuucuggaugugcagcaacggcucccugcagugccggaucugcaucuga

SEQ ID NO: 66478 - RNA, 1701 nt, Artificial Sequence; identical to SEQ ID NO: 63677
  derived and/or modified sequence opt1 from hemagglutinin__InfluenzaA__ADL32374

SEQ ID NO: 66479 - RNA, 1701 nt, Artificial Sequence
  derived and/or modified sequence opt1 from hemagglutinin__InfluenzaA__ADL32384
augaaggccauccuggugguccuccuguacaccuucgccaccgcgacggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66480 - RNA, 1701 nt, Artificial Sequence
  derived and/or modified sequence opt1 from hemagglutinin__InfluenzaA__ADL32394
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccaccagcuccuggagcuacaucguggagacguccagcuccgacaacgggaccugcuaccccggcgacuucaucgacuacgaggagcugcgggagcagcucagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcuggugaagaaggggaacagcuaccccaagcucuccaagagcuacaucaacgacaagggcaaggaggugcugguccugugggggauccaccaccccagcacguccgcggaccagcagagccucuaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccugguggucccccgguacgccuucgcgauggagcgcaacgccggguccggcaucaucaucagcgacacccccgugcacgacugcaacaccacgugccagaccccgaagggcgccaucaacaccucccuccccuuccagaacauccaccccaucaccaucgggaagugccccaaguacgucaagagcacgaagcugcggcuggccaccggccuccgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgucaucgagaagaugaacacccaguucaccgccgugggcaaggaguucaaccaccuggagaagcgcaucgagaaccugaacaagaagaucgacgacggcuuccuggacaucuggaccuacaacgcggagcuccugguccugcucgagaacgagcggacgcuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgccaucuacuccaccguggccagcagccugguccugguggugucccucggggcgaucagcuucuggaugugcuccaacggcagccugcagugccggaucugcaucuga

SEQ ID NO: 66481 - RNA, 1701 nt, Artificial Sequence; identical to SEQ ID NO: 63677
  derived and/or modified sequence opt1 from hemagglutinin__InfluenzaA__ADL32404

SEQ ID NO: 66482 - RNA, 1701 nt, Artificial Sequence
  derived and/or modified sequence opt1 from hemagglutinin__InfluenzaA__ADL32414
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggcgcaggagggccgcaugaacuacuacuggacccugguggagcccggggacaagaucaccuucgaggccaccggcaaccucguggucccccgguacgccuucgccauggagcgcaacgccggguccggcaucaucaucagcgacacgcccgugcacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagcacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 66483 - RNA, 1701 nt, Artificial Sequence
  derived and/or modified sequence opt1 from hemagglutinin__InfluenzaA__ADL32424
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuaccacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucaacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66484 - RNA, 1701 nt, Artificial Sequence
  derived and/or modified sequence opt1 from hemagglutinin__InfluenzaA__ADL32434
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccauccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggauccugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66485 - RNA, 1701 nt, Artificial Sequence; identical to SEQ ID NO: 65097
  derived and/or modified sequence opt1 from hemagglutinin__InfluenzaA__ADL32444

SEQ ID NO: 66486 - RNA, 1701 nt, Artificial Sequence
  derived and/or modified sequence opt1 from hemagglutinin__InfluenzaA__ADL32454
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagcuggggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccagcucccucgugcugguggucagccugggggccaucuccuucuggaugugcagcaacggcucccuccagugccggaucugcaucuga

SEQ ID NO: 66487 - RNA, 1701 nt, Artificial Sequence; identical to SEQ ID NO: 65844
  derived and/or modified sequence opt1 from hemagglutinin__InfluenzaA__ADL32464

SEQ ID NO: 66488 - RNA, 1701 nt, Artificial Sequence; identical to SEQ ID NO: 65844
  derived and/or modified sequence opt1 from hemagglutinin__InfluenzaA__ADL32484

SEQ ID NO: 66489 - RNA, 1701 nt, Artificial Sequence
  derived and/or modified sequence opt1 from hemagglutinin__InfluenzaA__ADL32504
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcaugugcuaccccggcgacuucaucgacuacgaggagcuccgggagcagcugagcuccgugagcuccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66490 - RNA, 1701 nt, Artificial Sequence; identical to SEQ ID NO: 65097
  derived and/or modified sequence opt1 from hemagglutinin__InfluenzaA__ADL32514

SEQ ID NO: 66491 - RNA, 1701 nt, Artificial Sequence; identical to SEQ ID NO: 65844
  derived and/or modified sequence opt1 from hemagglutinin__InfluenzaA__ADL32524

SEQ ID NO: 66492 - RNA, 1701 nt, Artificial Sequence
  derived and/or modified sequence opt1 from hemagglutinin__InfluenzaA__ADL32544
augaaggccauccuggugguccuccuguacaccuucgccaccagcaacgcggacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugcgcaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgccaccggccugcggaacgugccguccauccagagccgcgggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggugaacuccgucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 66493 - RNA, 1701 nt, Artificial Sequence; identical to SEQ ID NO: 66278
  derived and/or modified sequence opt1 from hemagglutinin__InfluenzaA__ADL32554

SEQ ID NO: 66494 - RNA, 1701 nt, Artificial Sequence; identical to SEQ ID NO: 65290
  derived and/or modified sequence opt1 from hemagglutinin__InfluenzaA__ADL32670

SEQ ID NO: 66495 - RNA, 1701 nt, Artificial Sequence
  derived and/or modified sequence opt1 from hemagglutinin__InfluenzaA__ADL32690
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugauguggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 66496 - RNA, 1701 nt, Artificial Sequence; identical to SEQ ID NO: 63857
  derived and/or modified sequence opt1 from hemagglutinin__InfluenzaA__ADL32710

SEQ ID NO: 66497 - RNA, 1701 nt, Artificial Sequence; identical to SEQ ID NO: 63677
  derived and/or modified sequence opt1 from hemagglutinin__InfluenzaA__ADL32720

SEQ ID NO: 66498 - RNA, 1701 nt, Artificial Sequence; identical to SEQ ID NO: 65449
  derived and/or modified sequence opt1 from hemagglutinin__InfluenzaA__ADL32730

SEQ ID NO: 66499 - RNA, 1701 nt, Artificial Sequence; identical to SEQ ID NO: 65449
  derived and/or modified sequence opt1 from hemagglutinin__InfluenzaA__ADL32740

SEQ ID NO: 66500 - RNA, 1701 nt, Artificial Sequence; identical to SEQ ID NO: 64621
  derived and/or modified sequence opt1 from hemagglutinin__InfluenzaA__ADL39137

SEQ ID NO: 66501 - RNA, 1698 nt, Artificial Sequence
  derived and/or modified sequence opt1 from hemagglutinin__InfluenzaA__ADL39148
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccgggacuucggcagcgggaucaucaacuccaacgcccccauggacaagugcgacgccaagugccagacgccccagggcgcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgucaagcucgaguccauggggguguaccagauccuggcgaucuacagcaccguggccagcucccugguccuccuggugagccugggcgccaucuccuucuggaugugcagcaacggcucccuccagugccgcaucugcaucuga

SEQ ID NO: 66502 - RNA, 1701 nt, Artificial Sequence
  derived and/or modified sequence opt1 from hemagglutinin__InfluenzaA__ADL39159
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagaucaucgacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaaguucaaguaccccgcccugaacgugaccaugcccaacaacgagcaguucgacaagcuguacaucuggggcguccaccaccccgggaccgacaacgaccagaucuuccucuacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcauccgcuccauccggaacgggaccuacgaccacgacgucuaccgcgacgaggcccugaacaaccgguuccagaucaagggcguggagcucaagagcggguacaaggacuggauccuguggaucuccuucgccaucagcugcuuccugcucugcuucgcccugcugggcuucaucaugugggccugccagaagggcaacauccgcugcaacaucugcaucuga

SEQ ID NO: 66503 - RNA, 1701 nt, Artificial Sequence
  derived and/or modified sequence opt1 from hemagglutinin__InfluenzaA__ADL39170
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccguccccaacaacgagcaguucgacaagcucuacaucuggggcgugcaccaccccgggaccgacaaggaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacguccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66504 - RNA, 1701 nt, Artificial Sequence; identical to SEQ ID NO: 64621
  derived and/or modified sequence opt1 from hemagglutinin__InfluenzaA__ADL39203

SEQ ID NO: 66505 - RNA, 1701 nt, Artificial Sequence; identical to SEQ ID NO: 63442
  derived and/or modified sequence opt1 from hemagglutinin__InfluenzaA__ADL39214

SEQ ID NO: 66506 - RNA, 1698 nt, Artificial Sequence
  derived and/or modified sequence opt1 from hemagglutinin__InfluenzaA__ADL39225
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccggggccuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccgucgccagcagccuggugcuccuggugucccugggcgccaucagcuucuggaugugcuccaacgggagccuccagugccggaucugcaucuga

SEQ ID NO: 66507 - RNA, 1698 nt, Artificial Sequence
  derived and/or modified sequence opt1 from hemagglutinin__InfluenzaA__ADL39236
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacaccaacaacaaggagaaggaggugcucguccuguggggcgugcaccacccgcccaacaucguggaccagaagacgcuguaccggaccgagaacgccuacgucagcguggugagcucccacuacagccgcaaguucacccccgagaucgccaagcggcccaagguccgcgaccaggagggccggaucaacuacuacuggacccuccuggagcccggcgacacgaucaucuucgaggccaacgggaaccugaucgccccgcgcuacgcguucgcccucucccggggcuucgggagcggcaucaucaacuccaacgcccccaugggcaagugcgacgccaagugccagacgccccagggggccaucaacagcucccugcccuuccagaacgugcacccggugaccaucggcgagugccccaaguacguccgcagcgcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucaccaacaaggucaacagcgugaucgagaagaugaacacccaguucacggccgucgggaaggaguucaacaagcuggagcgccggauggagaaccucaacaagaagguggacgacggcuucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgucaagcucgaguccaugggcguguaccagauccuggccaucuacagcacgguggcgagcucccugguccuccuggugagccugggggccaucuccuucuggaugugcagcaacggcucccuccagugccgcaucugcaucuga

SEQ ID NO: 66508 - RNA, 1701 nt, Artificial Sequence
  derived and/or modified sequence opt1 from hemagglutinin__InfluenzaA__ADL39280
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 66509 - RNA, 1698 nt, Artificial Sequence
  derived and/or modified sequence opt1 from hemagglutinin__InfluenzaA__ADL39291
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaugggggaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccggaucugcaucuga

SEQ ID NO: 66510 - RNA, 1701 nt, Artificial Sequence; identical to SEQ ID NO: 63442
  derived and/or modified sequence opt1 from hemagglutinin__InfluenzaA__ADL39302

SEQ ID NO: 66511 - RNA, 1701 nt, Artificial Sequence; identical to SEQ ID NO: 66508
  derived and/or modified sequence opt1 from hemagglutinin__InfluenzaA__ADL39313

SEQ ID NO: 66512 - RNA, 1701 nt, Artificial Sequence
  derived and/or modified sequence opt1 from hemagglutinin__InfluenzaA__ADL39335
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgauccaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 66513 - RNA, 1701 nt, Artificial Sequence; identical to SEQ ID NO: 63442
  derived and/or modified sequence opt1 from hemagglutinin__InfluenzaA__ADL39368

SEQ ID NO: 66514 - RNA, 1698 nt, Artificial Sequence
  derived and/or modified sequence opt1 from hemagglutinin__InfluenzaA__ADL39390
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccagccuguccaagagcuacgccaacaacaaggagaaggaggugcucguccuguggggcgugcaccacccgcccaacaucguggaccagaagacccuguaccggacggagaacgccuacgucagcgugguguccagccacuacucccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucagccggggcuucggguccggcaucaucaacagcaacgcccccaugggcaagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcguguaccagauccuggcgaucuacagcaccguggccuccagccugguccuccuggugucccugggggccaucagcuucuggaugugcuccaacggcagccuccagugccgcaucugcaucuga

SEQ ID NO: 66515 - RNA, 1701 nt, Artificial Sequence
  derived and/or modified sequence opt1 from hemagglutinin__InfluenzaA__ADL39401
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcuccugcaugcgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcccaggcguccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggcggggccaggccgccgaccucaagagcacccaggccgcgaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 66516 - RNA, 1701 nt, Artificial Sequence
  derived and/or modified sequence opt1 from hemagglutinin__InfluenzaA__ADL39412
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgagaaguccagcaucaugcgguccgacgcccccaucgggaagugcaacagcgagugcaucacgcccaacggcuccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacgggugggagggcaugguggacggcugguacggguuccgccaccagaacagcgagggccgggggcaggccgccgaccugaaguccacccaggcggccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 66517 - RNA, 1698 nt, Artificial Sequence
  derived and/or modified sequence opt1 from hemagglutinin__InfluenzaA__ADL39423
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccucccacacggucaccggggugagcgccuccugcagccacaacggcgagaacuccuucuaccgcaaccugcuguggcucaccgggaagaacggccuguaccccaaccugagcaaguccuacgccaacaacaaggagaaggaggugcucguccuguggggcgugcaccacccgcccaacaucgccgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagaaccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccagcagccuggugcuccuggucucccugggcgccaucagcuucuggaugugcuccaacgggagccuccagugccggaucugcaucuga

SEQ ID NO: 66518 - RNA, 1701 nt, Artificial Sequence
  derived and/or modified sequence opt1 from hemagglutinin__InfluenzaA__ADL39434
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcgacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 66519 - RNA, 1698 nt, Artificial Sequence
  derived and/or modified sequence opt1 from hemagglutinin__InfluenzaA__ADL39445
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccacccugagcaaguccuacgccaacaacaaggagaaggaggugcucguccuguggggcgugcaccacccgcccaacaucguggaccagaagacgcuguaccggaccgagaacgccuacgucagcguggugagcucccacuacagccgcaaguucacccccgagaucgccaagcggcccaagguccgcgaccaggagggccggaucaacuacuacuggacccuccuggagcccggcgacacgaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggucaacagcgugaucgagaagaugaacacccaguucacggccgucggcaaggaguucaacaagcuggagcgccggauggagaaccucaacaagaagguggacgacggguucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacagcacgguggccagcucccugguccuccuggugagccugggcgccaucuccuucuggaugugcagcaacgggucccuccagugccgcaucugcaucuga

SEQ ID NO: 66520 - RNA, 1698 nt, Artificial Sequence
  derived and/or modified sequence opt1 from hemagglutinin__InfluenzaA__ADL39456
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccucccacacggucaccggggugagcgccuccugcagccacaacggcgagaacuccuucuaccgcaaccugcuguggcucaccgggaagaacggccuguaccccaaccugagcaaguccuacgccaacaacaaggagaaggaggugcucguccuguggggcgugcaccacccgcccaacaucgccgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacagcaccguggccagcucccuggugcuccuggucagccugggcgccaucuccuucuggaugugcagcaacgggucccuccagugccggaucugcaucuga

SEQ ID NO: 66521 - RNA, 1698 nt, Artificial Sequence
  derived and/or modified sequence opt1 from hemagglutinin__InfluenzaA__ADL39467
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 66522 - RNA, 1701 nt, Artificial Sequence; identical to SEQ ID NO: 63677
  derived and/or modified sequence opt1 from hemagglutinin__InfluenzaA__ADL41164

SEQ ID NO: 66523 - RNA, 1701 nt, Artificial Sequence; identical to SEQ ID NO: 63770
  derived and/or modified sequence opt1 from hemagglutinin__InfluenzaA__ADL41173

SEQ ID NO: 66524 - RNA, 1698 nt, Artificial Sequence
  derived and/or modified sequence opt1 from hemagglutinin__InfluenzaA__ADL60242
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuaccggaaccugcuguggcucaccgggaagaacggccuguaccccaaccuguccaagagcuacgccaacaacaaggagaaggaggugcucguccuguggggcgugcaccacccgcccgacaucggcaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucagccggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccagcagccuggugcuccuggucucccugggggccaucagcuucuggaugugcuccaacggcagccuccagugccgcaucugcaucuga

SEQ ID NO: 66525 - RNA, 1698 nt, Artificial Sequence
  derived and/or modified sequence opt1 from hemagglutinin__InfluenzaA__ADL60253
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggagcuacaucguggagaagcccaaccccgagaacgggaccugcuaccccggguacuucgccgacuacgaggagcugcgcgagcagcucuccagcguguccagcuucgagcgguucgagaucuucccgaaggaguccagcuggcccaaccacacggucaccggcguguccgccagcugcucccacaacggggagagcuccuucuaccgcaaccugcuguggcucaccggcaagaacgggcuguaccccaaccugagcaaguccuacgccaacaacaaggagaaggaggugcucguccuguggggcgugcaccacccgcccaacaucggcaaccagaaggcccuguaccacaccgagaacgccuacgugagcgucgugagcucccacuacagccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 66526 - RNA, 1698 nt, Artificial Sequence; identical to SEQ ID NO: 66524
  derived and/or modified sequence opt1 from hemagglutinin__InfluenzaA__ADL60264

SEQ ID NO: 66527 - RNA, 1698 nt, Artificial Sequence; identical to SEQ ID NO: 66524
  derived and/or modified sequence opt1 from hemagglutinin__InfluenzaA__ADL60275

SEQ ID NO: 66528 - RNA, 1698 nt, Artificial Sequence
  derived and/or modified sequence opt1 from hemagglutinin__InfluenzaA__ADL60286
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcaaccagaagacccuguaccacacggagaacgccuacguguccgucgugagcucccacuacagccggaaguucacccccgagguggccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggucaagcucgagagcaugggcguguaccagauccuggcgaucuacuccaccguggccagcucccugguccuccuggugagccugggcgccaucuccuucuggaugugcagcaacgggucccuccagugccggaucugcaucuga

SEQ ID NO: 66529 - RNA, 1698 nt, Artificial Sequence
  derived and/or modified sequence opt1 from hemagglutinin__InfluenzaA__ADL60297
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccagcugcucccacaacggcgagagcuccuucuaccgcaaccugcuguggcucacccggaagaacgggcuguaccccaaccugagcaaguccuacgccaacaacaaggagaaggaggugcucguccuguggggcgugcaccacccgcccaacaucggggaccagaagacccuguaccacacggagaacgccuacgugagcgucgugagcucccacuacagccgcaaguucacccccgagaucgccaagcggcccaaggugcgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacagccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggggugaagcucgagagcaugggcgucuaccagauccuggcgaucuacagcaccguggccuccagccuggugcuccuggucucccugggcgccaucagcuucuggaugugcuccaacgggagccuccagugccgcaucugcaucuga

SEQ ID NO: 66530 - RNA, 1698 nt, Artificial Sequence
  derived and/or modified sequence opt1 from hemagglutinin__InfluenzaA__ADL60308
augaaggugaagcugcucguccugcugugcaccuucgccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacagccggaaguucacccccgagaucgcgaagcgccccaagguccgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacgcaguucaccgccgucgggaaggaguucaacaagcuggagcggcgcauggagaaccucaacaagaagguggacgacggcuucaucgacaucuggaccuacaacgcggagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 66531 - RNA, 1698 nt, Artificial Sequence
  derived and/or modified sequence opt1 from hemagglutinin__InfluenzaA__ADL60341
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaucgccuacgucagcguggugagcucccacuacagccggaaguucacgcccgagaucgccaagcgccccaagguccgggaccaggagggccgcaucaacuacuacuggaccauccucgagcccggggacaccaucaucuucgaggcgaacggcaaccugaucgccccgcgguacgccuucgcccugucccgcggguucggcagcggcaucaucaacuccaacgcccccauggacaagugcgacgcgaagugccagacgccccagggggccaucaacagcucccuccccuuccagaacgugcacccggugaccaucggcgagugccccaaguacguccggagcgccaagcugcgcauggugaccgggcugcggaacauccccuccauccagagccgcggccucuucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccugaacaagaagguggacgacggcuucaucgacaucuggaccuacaacgccgagcuccuggugcugcucgagaacgagcggacgcuggacuuccacgacagcaacgucaagaaccuguacgagaaggugaagucccagcucaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcuggaguccaugggcguguaccagauccucgccaucuacagcaccguggccagcucccugguccugcucgugagccugggggccaucuccuucuggaugugcagcaacggcucccugcagugccggaucugcaucuga

SEQ ID NO: 66532 - RNA, 1698 nt, Artificial Sequence
  derived and/or modified sequence opt1 from hemagglutinin__InfluenzaA__ADL60352
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccggguacgaggagcugcgcgagcagcucuccagcguguccagcuucgagcgguucgagaucuucccgaaggaguccagcuggcccaaccacacggucaccggcguguccgccagcugcucccacaacggggagcgcagcuucuaccggaaccugcuguggcucaccggcaagaacgggcuguaccccaaccuguccaagagcuacgccaacaacaaggagaaggaggugcucguccuguggggcgugcaccacccgcccgacaucggcaaccagaagacccuguaccacacggagaacgccuacguguccgucgugagcagccacuacucccgcaaguucacccccgagaucgccaagcggcccaaggugcgcgaccaggaggggcggaucaacuacuacuggacccuccuggagcccggcgacaccaucaucuucgaggccaacgggaaccugaucgcgccgcgcuacgccuucgcccucagccggggcuucggcuccgggaucaucaacagcaacgcccccauggacaagugcgacgccaagugccagacgccccagggcgcgaucaacuccagccugcccuuccagaacguccacccggugaccaucggggagugccccaaguacgugcgcuccgccaagcugcggauggucaccggccuccgcaacauccccagcauccagucccgggggcuguucggcgccaucgccggcuucaucgagggcggcuggaccgggaugguggacggcugguacggguaccaccaccagaacgagcagggcagcggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggcgugaagcucgagagcaugggggucuaccagauccuggcgaucuacuccaccguggccagcagccuggugcuccuggucucccugggcgccaucagcuucuggaugugcuccaacgggagccuccagugccgcaucugcaucuga

SEQ ID NO: 66533 - RNA, 1701 nt, Artificial Sequence
  derived and/or modified sequence opt1 from hemagglutinin__InfluenzaA__ADL60363
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccugaucgccagcuccggcacgcucgaguucaacaacgagagcuucaacuggaccggggucacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcgugcaccaccccgggaccgacaacgaccagaucuuccuguacgcgcaggccuccgggcggaucaccaucagcacgaagcgcagccagcagaccgucaucccgaacaucggcucccggccccgcgugcgggacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgucaaccgcaucaccuacggggccugcccccgguacgugaagcagaacacccucaagcuggcgaccggcaugcgcaacgugcccgagaagcagacgcgggggaucuucggcgccaucgccggguucaucgagaacggcugggagggcauggucgacgggugguacggcuuccgccaccagaacuccgagggggugggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 66534 - RNA, 1698 nt, Artificial Sequence
  derived and/or modified sequence opt1 from hemagglutinin__InfluenzaA__ADL60374
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacgacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcgucgugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 66535 - RNA, 1701 nt, Artificial Sequence
  derived and/or modified sequence opt1 from hemagglutinin__InfluenzaA__ADM07135
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66536 - RNA, 1701 nt, Artificial Sequence; identical to SEQ ID NO: 64162
  derived and/or modified sequence opt1 from hemagglutinin__InfluenzaA__ADM07144

SEQ ID NO: 66537 - RNA, 1701 nt, Artificial Sequence
  derived and/or modified sequence opt1 from hemagglutinin__InfluenzaA__ADM07154
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccacccgcccaccagcgccgaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagcccggggacaagaucaccuucgaggcgaccggcaaccucguggucccccgguacgccuucgccauggugcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 66538 - RNA, 1701 nt, Artificial Sequence; identical to SEQ ID NO: 64162
  derived and/or modified sequence opt1 from hemagglutinin__InfluenzaA__ADM07163

SEQ ID NO: 66539 - RNA, 1698 nt, Artificial Sequence; identical to SEQ ID NO: 66521
  derived and/or modified sequence opt1 from hemagglutinin__InfluenzaA__ADM07460

SEQ ID NO: 66540 - RNA, 1701 nt, Artificial Sequence
  derived and/or modified sequence opt1 from hemagglutinin__InfluenzaA__ADM07504
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 66541 - RNA, 1701 nt, Artificial Sequence
  derived and/or modified sequence opt1 from hemagglutinin__InfluenzaA__ADM12806
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagagcacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 66542 - RNA, 1701 nt, Artificial Sequence; identical to SEQ ID NO: 66541
  derived and/or modified sequence opt1 from hemagglutinin__InfluenzaA__ADM12817

SEQ ID NO: 66543 - RNA, 1701 nt, Artificial Sequence; identical to SEQ ID NO: 66541
  derived and/or modified sequence opt1 from hemagglutinin__InfluenzaA__ADM12828

SEQ ID NO: 66544 - RNA, 1701 nt, Artificial Sequence; identical to SEQ ID NO: 66541
  derived and/or modified sequence opt1 from hemagglutinin__InfluenzaA__ADM12839

SEQ ID NO: 66545 - RNA, 1701 nt, Artificial Sequence
  derived and/or modified sequence opt1 from hemagglutinin__InfluenzaA__ADM12850
augaaggccaucaucgcccugagcuacauccucugccugguguucgcgcagaagcugcccggcaacgacaacuccaccgccacccucugccuggggcaccacgccgucccgaacggcacgaucgugaagaccaucaccaacgaccagaucgaggugaccaacgccacggagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcguacuccaacugcuaccccuacgacgugccggacuacgccagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcagccagcaggccgugaucccgaacaucggcagccggccccgcguccggaacauccccucccgcaucagcaucuacuggacgaucgugaagcccggcgacauccugcucaucaacuccaccgggaaccugaucgccccgcggggcuacuucaagauccgcagcgggaaguccagcaucaugcgguccgacgcgcccaucggcaagugcaacagcgagugcaucacccccaacggcuccauccccaacgacaagccguuccagaacgugaaccgcaucaccuacggggccugcccccgguacgucaagcagagcacgcugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaccaucuaccacaagugcgacaacgccugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 66546 - RNA, 1701 nt, Artificial Sequence; identical to SEQ ID NO: 63677
  derived and/or modified sequence opt1 from hemagglutinin__InfluenzaA__ADM12861

SEQ ID NO: 66547 - RNA, 1701 nt, Artificial Sequence; identical to SEQ ID NO: 63677
  derived and/or modified sequence opt1 from hemagglutinin__InfluenzaA__ADM12871

SEQ ID NO: 66548 - RNA, 1701 nt, Artificial Sequence; identical to SEQ ID NO: 63677
  derived and/or modified sequence opt1 from hemagglutinin__InfluenzaA__ADM12881

SEQ ID NO: 66549 - RNA, 1701 nt, Artificial Sequence; identical to SEQ ID NO: 63677
  derived and/or modified sequence opt1 from hemagglutinin__InfluenzaA__ADM12891

SEQ ID NO: 66550 - RNA, 1701 nt, Artificial Sequence; identical to SEQ ID NO: 63677
  derived and/or modified sequence opt1 from hemagglutinin__InfluenzaA__ADM12901

SEQ ID NO: 66551 - RNA, 1701 nt, Artificial Sequence; identical to SEQ ID NO: 64779
  derived and/or modified sequence opt1 from hemagglutinin__InfluenzaA__ADM12911

SEQ ID NO: 66552 - RNA, 1701 nt, Artificial Sequence; identical to SEQ ID NO: 63677
  derived and/or modified sequence opt1 from hemagglutinin__InfluenzaA__ADM12921

SEQ ID NO: 66553 - RNA, 1701 nt, Artificial Sequence; identical to SEQ ID NO: 63677
  derived and/or modified sequence opt1 from hemagglutinin__InfluenzaA__ADM12931

SEQ ID NO: 66554 - RNA, 1701 nt, Artificial Sequence; identical to SEQ ID NO: 63677
  derived and/or modified sequence opt1 from hemagglutinin__InfluenzaA__ADM12941

SEQ ID NO: 66555 - RNA, 1701 nt, Artificial Sequence; identical to SEQ ID NO: 63677
  derived and/or modified sequence opt1 from hemagglutinin__InfluenzaA__ADM12951

SEQ ID NO: 66556 - RNA, 1701 nt, Artificial Sequence
  derived and/or modified sequence opt1 from hemagglutinin__InfluenzaA__ADM12961
augaaggccgugcuggucgugcuccuguacaccuucgccaccgcgaacgccgacacgcugugcaucggcuaccacgccaacaacagcaccgacaccguggacaccguccucgagaagaacgugacggugacccacuccgucaacauccuggaggacaagcacaacgggaagcugugcaagcucggcgggguggcgccccugcaccugggcaagugcaacaucgccggguggauccucggcaacccggagugcgagagccuguccaccgccagcuccuggagcuacaucguggagaccuccagcuccgacaacggcacgugcuaccccggggacuucaucgacuacgaggagcugcgcgagcagcucagcuccgucagcuccuucgagcgguucgagaucuuccccaagaccagcuccuggcccaaccacgacagcaacaagggcgugaccgccgccugcccgcacgccggggcgaaguccuucuacaagaaccugaucuggcuggugaagaagggcaacagcuaccccaagcucuccaagagcuacaucaacgacaaggggaaggagguccuggugcuguggggcauccaccaccccagcaccuccgccgaccagcagagccucuaccagaacgccgacgccuacguguucgucggcacgucccgcuacagcaagaaguucaagcccgagaucgccauccggccgaaggugcgcgaccaggaggggcggaugaacuacuacuggacccugguggagcccggcgacaagaucaccuucgaggcgaccgggaaccuggucgugccccgcuacgccuucgccauggagcggaacgccggcuccggcaucaucaucagcgacacgcccgugcacgacugcaacacgaccugccagaccccgaagggggccaucaacaccucccuccccuuccagaacauccaccccaucaccaucggcaagugccccaaguacgucaagagcaccaagcugcgccuggcgaccgggcuccggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggguuccuggacaucuggaccuacaacgccgagcuccuggugcugcucgagaacgagcgcacccuggacuaccacgacagcaacgucaagaaccuguacgagaaggugcggucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggucaagcuggagagcacccggaucuaccagauccucgcgaucuacuccaccguggccagcagccuggugcuggucgugucccucggcgccaucagcuucuggaugugcuccaacggcagccugcagugccgcaucugcaucuga

SEQ ID NO: 66557 - RNA, 1701 nt, Artificial Sequence; identical to SEQ ID NO: 65326
  derived and/or modified sequence opt1 from hemagglutinin__InfluenzaA__ADM12971

SEQ ID NO: 66558 - RNA, 1701 nt, Artificial Sequence; identical to SEQ ID NO: 64778
  derived and/or modified sequence opt1 from hemagglutinin__InfluenzaA__ADM12981

SEQ ID NO: 66559 - RNA, 1701 nt, Artificial Sequence
  derived and/or modified sequence opt1 from hemagglutinin__InfluenzaA__ADM12991
augaaggccauccuggugguccuccuguacaccuucgagaccgccaacgcggacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66560 - RNA, 1701 nt, Artificial Sequence
  derived and/or modified sequence opt1 from hemagglutinin__InfluenzaA__ADM13001
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66561 - RNA, 1701 nt, Artificial Sequence; identical to SEQ ID NO: 64841
  derived and/or modified sequence opt1 from hemagglutinin__InfluenzaA__ADM13011

SEQ ID NO: 66562 - RNA, 1701 nt, Artificial Sequence
  derived and/or modified sequence opt1 from hemagglutinin__InfluenzaA__ADM13021
augaaggccauccuggugguccuccuguacaccuucgccaccgcgaacgccgacacgcugugcaucggcuaccacgccaacaacagcaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66563 - RNA, 1701 nt, Artificial Sequence; identical to SEQ ID NO: 65023
  derived and/or modified sequence opt1 from hemagglutinin__InfluenzaA__ADM13031

SEQ ID NO: 66564 - RNA, 1701 nt, Artificial Sequence
  derived and/or modified sequence opt1 from hemagglutinin__InfluenzaA__ADM13041
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66565 - RNA, 1701 nt, Artificial Sequence
  derived and/or modified sequence opt1 from hemagglutinin__InfluenzaA__ADM13051
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66566 - RNA, 1701 nt, Artificial Sequence
  derived and/or modified sequence opt1 from hemagglutinin__InfluenzaA__ADM13061
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacaccuccugccagaccccgaagggcgccaucaacaccagccugcccuuccagaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 66567 - RNA, 1701 nt, Artificial Sequence; identical to SEQ ID NO: 65844
  derived and/or modified sequence opt1 from hemagglutinin__InfluenzaA__ADM13071

SEQ ID NO: 66568 - RNA, 1701 nt, Artificial Sequence
  derived and/or modified sequence opt1 from hemagglutinin__InfluenzaA__ADM13081
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgcgagcuccuggagcuacaucgucgagaccuccggcagcgacaacggcacgugcuaccccggggacuucaucgacuacgaggagcuccgggagcagcuguccagcguguccagcuucgagcgcuucgagaucuuccccaagaccuccagcuggcccaaccacgacuccaacaagggcgugaccgccgccugcccgcacgccggggccaagagcuucuacaagaaccugaucuggcucgucaagaagggcaacuccuaccccaagcugagcaaguccuacaucaacgacaaggagaaggaggugcuggugcucugggggauccaccaccccagcaccagcgccgaccagcagucccuguaccagaacgccgacgccuacgucuucgugggcacgagccgguacuccaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgugccgagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 66569 - RNA, 1701 nt, Artificial Sequence; identical to SEQ ID NO: 65097
  derived and/or modified sequence opt1 from hemagglutinin__InfluenzaA__ADM13091

SEQ ID NO: 66570 - RNA, 1701 nt, Artificial Sequence; identical to SEQ ID NO: 64841
  derived and/or modified sequence opt1 from hemagglutinin__InfluenzaA__ADM13101

SEQ ID NO: 66571 - RNA, 1701 nt, Artificial Sequence
  derived and/or modified sequence opt1 from hemagglutinin__InfluenzaA__ADM13111
augaaggccauccuggugguccuccuguacaccuucgagaccgccaacgcggacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggaccccggggacaagaucaccuucgaggccaccggcaaccucguggucccccgguacgcguucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66572 - RNA, 1701 nt, Artificial Sequence; identical to SEQ ID NO: 63677
  derived and/or modified sequence opt1 from hemagglutinin__InfluenzaA__ADM13121

SEQ ID NO: 66573 - RNA, 1701 nt, Artificial Sequence; identical to SEQ ID NO: 64841
  derived and/or modified sequence opt1 from hemagglutinin__InfluenzaA__ADM13131

SEQ ID NO: 66574 - RNA, 1701 nt, Artificial Sequence; identical to SEQ ID NO: 65005
  derived and/or modified sequence opt1 from hemagglutinin__InfluenzaA__ADM13141

SEQ ID NO: 66575 - RNA, 1701 nt, Artificial Sequence; identical to SEQ ID NO: 65005
  derived and/or modified sequence opt1 from hemagglutinin__InfluenzaA__ADM13151

SEQ ID NO: 66576 - RNA, 1701 nt, Artificial Sequence; identical to SEQ ID NO: 64778
  derived and/or modified sequence opt1 from hemagglutinin__InfluenzaA__ADM13161

SEQ ID NO: 66577 - RNA, 1701 nt, Artificial Sequence; identical to SEQ ID NO: 65326
  derived and/or modified sequence opt1 from hemagglutinin__InfluenzaA__ADM13171

SEQ ID NO: 66578 - RNA, 1701 nt, Artificial Sequence; identical to SEQ ID NO: 65326
  derived and/or modified sequence opt1 from hemagglutinin__InfluenzaA__ADM13181

SEQ ID NO: 66579 - RNA, 1701 nt, Artificial Sequence
  derived and/or modified sequence opt1 from hemagglutinin__InfluenzaA__ADM13191
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 66580 - RNA, 1701 nt, Artificial Sequence
  derived and/or modified sequence opt1 from hemagglutinin__InfluenzaA__ADM13211
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcaucgcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 66581 - RNA, 1701 nt, Artificial Sequence; identical to SEQ ID NO: 66580
  derived and/or modified sequence opt1 from hemagglutinin__InfluenzaA__ADM13221

SEQ ID NO: 66582 - RNA, 1701 nt, Artificial Sequence
  derived and/or modified sequence opt1 from hemagglutinin__InfluenzaA__ADM13231
augaaggccauccuggugguccuccuguacaccuucgagaccgccaacgcggacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66583 - RNA, 1701 nt, Artificial Sequence; identical to SEQ ID NO: 64841
  derived and/or modified sequence opt1 from hemagglutinin__InfluenzaA__ADM13241

SEQ ID NO: 66584 - RNA, 1701 nt, Artificial Sequence
  derived and/or modified sequence opt1 from hemagglutinin__InfluenzaA__ADM13251
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcgacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66585 - RNA, 1701 nt, Artificial Sequence
  derived and/or modified sequence opt1 from hemagglutinin__InfluenzaA__ADM13261
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgcgagcuccuggagcuacaucgucgagaccuccggcagcgacaacggcacgugcuaccccggggacuucaucgacuacgaggagcuccgggagcagcuguccagcguguccagcuucgagcgcuucgagaucuuccccaagaccuccagcuggcccaaccacgacuccaacaagggcgugaccgccgccugcccgcacgccggggccaagagcuucuacaagaaccugaucuggcucgucaagaagggcaacuccuaccccaagcugagcaaguccuacaucaacgacaaggggaaggaggugcuggugcucuggggcauccaccaccccagcaccagcgccgaccagcagucccuguaccagaacgccgacgccuacgucuucgugggcacgagccgguacuccaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcagcggcaucaucaucuccgacacgcccguccacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgugccgagcauccagucccggggccuguucggggccaucgccggcuucaucgagggcggguggacgggcauggucgacgggugguacggcuaccaccaccagaacgagcaggggagcggcuacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacagcaccguggccuccagccugguccucguggugagccugggcgccaucuccuucuggaugugcagcaacggcucccugcagugccggaucugcaucuga

SEQ ID NO: 66586 - RNA, 1701 nt, Artificial Sequence
  derived and/or modified sequence opt1 from hemagglutinin__InfluenzaA__ADM13271
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcauccaccagauccuggcgaucuacuccaccgucgccagcagccuggugcucguggucucccugggggccaucagcuucuggaugugcuccaacggcagccugcagugccggaucugcaucuga

SEQ ID NO: 66587 - RNA, 1701 nt, Artificial Sequence; identical to SEQ ID NO: 66582
  derived and/or modified sequence opt1 from hemagglutinin__InfluenzaA__ADM13281

SEQ ID NO: 66588 - RNA, 1701 nt, Artificial Sequence; identical to SEQ ID NO: 64778
  derived and/or modified sequence opt1 from hemagglutinin__InfluenzaA__ADM13291

SEQ ID NO: 66589 - RNA, 1701 nt, Artificial Sequence
  derived and/or modified sequence opt1 from hemagglutinin__InfluenzaA__ADM13301
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggagaacagcuaccccaagcuguccaagagcuacaucaacgacaaggggaaggaggugcuggugcucuggggcauccaccaccccagcaccuccgccgaccagcagagccuguaccagaacgucgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggccaccgggaaccucguggucccccgguacgcguucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgccaccgggcugcgcaacgugccguccauccagagccggggccuguucggggcgaucgccggcuucaucgagggcggguggacgggcaugguggacgggugguacggcuaccaccaccagaacgagcagggguccggcuacgccgccgaccucaagagcacccagaacgccaucgacgagaucaccaacaaggugaacuccgucaucgagaagaugaacacccaguucacggcgguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacgggagccugcagugccggaucugcaucuga

SEQ ID NO: 66590 - RNA, 1701 nt, Artificial Sequence
  derived and/or modified sequence opt1 from hemagglutinin__InfluenzaA__ADM13311
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggagaacaagcacaacgggaagcucugcaagcugcgcggcgugagcccccugcaccucgggaagugcaacaucgccggcuggauccuggggaacccggagugcgagucccugagcaccgccuccagcugguccuacaucgucgagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggugaccgcggccugcccgcacgccggcgccaagagcuucuacaagaaccugaucuggcucgucaagaaggggaacuccuaccccaagcugagcaagagcuacaucaacgacaagggcaaggaggugcuggugcucugggggauccaccaccccuccaccagcgcggaccagcagucccuguaccagaacgccgacgccuacgucuucgugggcacgagccgguacuccaagaaguucaagcccgagaucgccauccgcccgaaggugcgggaccaggagggccgcaugaacuacuacuggacccuggucgagcccggggacaagaucaccuucgaggccaccggcaaccucguggugccccgguacgcguucgccauggagcgcaacgccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgugccgagcauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccgcggccagcucccuggugcucgucgugagccugggggccaucuccuucuggaugugcagcaacggcucccugcagugccggaucugcaucuga

SEQ ID NO: 66591 - RNA, 1701 nt, Artificial Sequence; identical to SEQ ID NO: 64841
  derived and/or modified sequence opt1 from hemagglutinin__InfluenzaA__ADM13321

SEQ ID NO: 66592 - RNA, 1701 nt, Artificial Sequence
  derived and/or modified sequence opt1 from hemagglutinin__InfluenzaA__ADM13331
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66593 - RNA, 1701 nt, Artificial Sequence; identical to SEQ ID NO: 65290
  derived and/or modified sequence opt1 from hemagglutinin__InfluenzaA__ADM13341

SEQ ID NO: 66594 - RNA, 1701 nt, Artificial Sequence; identical to SEQ ID NO: 66256
  derived and/or modified sequence opt1 from hemagglutinin__InfluenzaA__ADM13351

SEQ ID NO: 66595 - RNA, 1701 nt, Artificial Sequence; identical to SEQ ID NO: 63337
  derived and/or modified sequence opt1 from hemagglutinin__InfluenzaA__ADM13442

SEQ ID NO: 66596 - RNA, 1701 nt, Artificial Sequence; identical to SEQ ID NO: 63337
  derived and/or modified sequence opt1 from hemagglutinin__InfluenzaA__ADM13443

SEQ ID NO: 66597 - RNA, 1701 nt, Artificial Sequence; identical to SEQ ID NO: 63337
  derived and/or modified sequence opt1 from hemagglutinin__InfluenzaA__ADM13444

SEQ ID NO: 66598 - RNA, 1701 nt, Artificial Sequence; identical to SEQ ID NO: 64284
  derived and/or modified sequence opt1 from hemagglutinin__InfluenzaA__ADM13445

SEQ ID NO: 66599 - RNA, 1701 nt, Artificial Sequence; identical to SEQ ID NO: 63337
  derived and/or modified sequence opt1 from hemagglutinin__InfluenzaA__ADM13446

SEQ ID NO: 66600 - RNA, 1701 nt, Artificial Sequence
  derived and/or modified sequence opt1 from hemagglutinin__InfluenzaA__ADM13447
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuacagcgugcugaacgucacgaugcccaacaacgacaacuucgacaagcucuacaucuggggcgugcaccaccccuccaccaaccaggagcagaccagccuguacgugcaggccuccgggcgggucaccgugagcacgcgccggagccagcagaccaucaucccgaacaucggcucccgccccugggugcggggccugagcucccgcaucagcaucuacuggaccaucgucaagcccggggacgugcucgugaucaacuccaacggcaaccugaucgcgccccggggguacuucaagaugcgcaccggcaagagcuccaucaugcggagcgacgccccgaucgacacgugcaucuccgagugcaucacccccaacgggagcauccccaacgacaagcccuuccagaacgucaacaagaucaccuacggcgccugcccgaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 66601 - RNA, 1701 nt, Artificial Sequence; identical to SEQ ID NO: 63407
  derived and/or modified sequence opt1 from hemagglutinin__InfluenzaA__ADM13448

SEQ ID NO: 66602 - RNA, 1701 nt, Artificial Sequence
  derived and/or modified sequence opt1 from hemagglutinin__InfluenzaA__ADM13449
augaagaccaucaucgcccugagcuacaucuucugccucgccuucggccaggaccugcccgggaacgacaacuccaccgcgacgcugugccucggccaccacgccgugccgaacgggacccuggucaagaccaucaccgacgaccagaucgaggugacgaacgccaccgagcuggugcagagcuccagcaccggcaagaucugcaacaacccccaccgcauccucgacgggaucgacugcacccugaucgacgcccugcucggcgacccccacugcgacgucuuccagaacgagacgugggaccuguucguggagcgguccaaggccuucagcaacugcuaccccuacgacgugccggacuacgcgucccugcgcagccucgucgccuccagcggcacccuggaguucaucaccgagggguucaccuggacgggcgugacccagaacgggggcuccaacgccugcaagcgggggcccggcagcggcuucuucucccgccugaacuggcucaccaagagcggguccaccuaccccgugcugaacgucacgaugcccaacaacgacaacuucgacaagcuguacaucuggggcgugcaccacccgagcaccaaccaggagcagaccucccucuacgugcaggccagcgggcgggucaccguguccacgcgccggagccagcagaccaucauccccaacaucgagagccgccccugggugcggggccuguccagccgcaucuccaucuacuggaccaucgucaaccccggcgacgugcuggugaucaacagcaacgggaaccucaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcuggccacgggcaugcgcaacgugcccgagaagcagacccggggccucuucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcugaaccgggucaucgagaagacgaacgagaaguuccaccagaucgagaaggaguucagcgagguggaggggcgcauccaggaccucgagaaguacguggaggacaccaagaucgaccugugguccuacaacgcggagcugcucgucgcccuggagaaccagcacaccaucgaccugaccgacagcgagaugaacaagcuguucgagaagacgcggcgccagcuccgggagaacgccgaggacaugggcaacgggugcuucaagaucuaccacaagugcgacaacgccugcaucgaguccauccgcaacggcaccuacgaccacgacguguaccgcgacgaggcccugaacaaccgguuccagaucaagggcgucgagcucaagagcggguacaaggacuggauccuguggaucuccuucgcgaucagcugcuuccugcucugcguggugcugcugggcuucaucaugugggccugccagcgcgggaacauccggugcaacaucugcaucuga

SEQ ID NO: 66603 - RNA, 1701 nt, Artificial Sequence; identical to SEQ ID NO: 63439
  derived and/or modified sequence opt1 from hemagglutinin__InfluenzaA__ADM13450

SEQ ID NO: 66604 - RNA, 1701 nt, Artificial Sequence
  derived and/or modified sequence opt1 from hemagglutinin__InfluenzaA__ADM13451
augaagaccaucaucgcccugagcuacaucuucugccucgcccugggccaggaccugcccgggaacgacaaccgcaccgcgacgcucugccugggccaccacgccgugccgaacgggacccuggucaagaccaucaccgacgaccagaucgaggugacgaacgccaccgagcucgugcaguccagcuccaccggcaagaucugcaacaacccccaccggauccuggacgggaucgacugcacccugaucgacgcccuccugggcgacccccacugcgacgucuuccagaacgagacgugggaccuguucguggagcgcagcaaggccuucuccaacugcuaccccuacgacgugccggacuacgcgagccuccggucccuggucgccagcuccggcacccuggaguucaucaccgagggguucaccuggacgggcgugacccagaacgggggcagcaacgccugcaagcgcgggcccggcuccggcuucuucagccggcucaacuggcugaccaaguccgggagcaccuaccccgugcugaacgucacgaugcccaacaacgacaacuucgacaagcucuacaucuggggcgugcaccacccguccaccaaccaggagcagaccagccuguacgugcaggccuccgggcgcgucaccgugagcacgcggcgcucccagcagaccaucauccccaacaucggcagccggcccugggugcgcggccugagcucccggaucagcaucuacuggaccaucgucaagcccggggacgugcucgugaucaacuccaacggcaaccugaucgcgccgcgcggguacuucaagaugcggaccggcaagagcuccaucaugcgcagcgacgcccccaucgacacgugcaucuccgagugcaucacccccaacgggagcauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacuccgaggggaccggccaggccgccgaccucaagagcacccaggccacgaucgaccagaucaacgggaagcugaaccgcgucaucgagaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagacccgccggcagcugcgcgagaacgccgaggacauggggaacggcugcuucaagaucuaccacaagugcgacaacgccugcaucgagagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggugcugcucggguucaucaugugggcgugccagcggggcaacauccgcugcaacaucugcaucuga

SEQ ID NO: 66605 - RNA, 1701 nt, Artificial Sequence; identical to SEQ ID NO: 63324
  derived and/or modified sequence opt1 from hemagglutinin__InfluenzaA__ADM13452

SEQ ID NO: 66606 - RNA, 1701 nt, Artificial Sequence
  derived and/or modified sequence opt1 from hemagglutinin__InfluenzaA__ADM14467
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccaguccauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 66607 - RNA, 1695 nt, Artificial Sequence
  derived and/or modified sequence opt1 from hemagglutinin__InfluenzaA__ADM14516
augaaggccauccuggugguccuccuguacaccuucgccaccgcgaacgccgacacgcugugcaucggcuaccacgccaacaacagcaccgacaccgugaacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccggccacagcugccggaucugcaucuga

SEQ ID NO: 66608 - RNA, 1701 nt, Artificial Sequence
  derived and/or modified sequence opt1 from hemagglutinin__InfluenzaA__ADM14525
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcucccugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggacgugcucgugcugugggggauccaccaccccagcacguccgccgaccagcagagccuguaccagaacgccgacgccuacgucuucgugggcaccucccgguacagcaagaaguucaagcccgagaucgccauccgcccgaaggugcgggaccaggagggccgcaugaacuacuacuggacccucgucgagcccggggacaagaucaccuucgaggcgacgggcaaccugguggugccccgguacgccuucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcuccggcuggcgacgggccugcgcaacgugccguccauccagagccggggccucuucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgugaucgagaagaugaacacgcaguucaccgccgucggcaaggaguucaaccaccuggagaagcgcaucgagaaccugaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 66609 - RNA, 1695 nt, Artificial Sequence
  derived and/or modified sequence opt1 from hemagglutinin__InfluenzaA__ADM14553
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucguggagacgucccgguacagcaagaaguucaagcccgagaucgccauccgcccgaaggugcgggaccaggagggccgcaugaacuacuacuggacccuggucgagcccggcgacaagaucaccuucgaggcgaccgggaaccucguggugccccgguacgccuucgccauggagcgcaacgccggcuccgggaucaucaucagcgacacguccguccacgacugcaacacgaccugccagacccccaagggcgccaucaacaccagccugccguuccagaacauccaccccaucaccaucggcaagugccccaaguacgugaaguccaccaagcugcggcucgcgaccgggcugcgcaacgugcccagcauccagucccggggccuguucggggccaucgccggcuucaucgagggcggguggacgggcauggucgacgggugguacggcuaccaccaccagaacgagcaggggagcggcuacgccgccgaccucaaguccacccagaacgcgaucgacgagaucaccaacaaggugaacagcgugaucgagaagaugaacacccaguucacggccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucggcaacgggugcuucgaguucuaccacaagugcgacaacacgugcauggaguccgucaagaacggcaccuacgacuacccgaaguacagcgaggaggccaagcugaaccgggaggagaucgacggggugaagcucgaguccacccgcaucuaccagauccuggcgaucuacagcaccguggccagcucccugguccucguggugagccugggcgccaucuccuucuggaugugcagcgggcacuccugccggaucugcaucuga

SEQ ID NO: 66610 - RNA, 1701 nt, Artificial Sequence; identical to SEQ ID NO: 64124
  derived and/or modified sequence opt1 from hemagglutinin__InfluenzaA__ADM14562

SEQ ID NO: 66611 - RNA, 1701 nt, Artificial Sequence; identical to SEQ ID NO: 63677
  derived and/or modified sequence opt1 from hemagglutinin__InfluenzaA__ADM14571

SEQ ID NO: 66612 - RNA, 1701 nt, Artificial Sequence
  derived and/or modified sequence opt1 from hemagglutinin__InfluenzaA__ADM14580
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucaacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66613 - RNA, 1701 nt, Artificial Sequence
  derived and/or modified sequence opt1 from hemagglutinin__InfluenzaA__ADM14589
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacggccagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucaacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 66614 - RNA, 1701 nt, Artificial Sequence
  derived and/or modified sequence opt1 from hemagglutinin__InfluenzaA__ADM14599
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgucauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 66615 - RNA, 1701 nt, Artificial Sequence; identical to SEQ ID NO: 64837
  derived and/or modified sequence opt1 from hemagglutinin__InfluenzaA__ADM14609

SEQ ID NO: 66616 - RNA, 1701 nt, Artificial Sequence
  derived and/or modified sequence opt1 from hemagglutinin__InfluenzaA__ADM14618
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacaaccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66617 - RNA, 1701 nt, Artificial Sequence; identical to SEQ ID NO: 63677
  derived and/or modified sequence opt1 from hemagglutinin__InfluenzaA__ADM14627

SEQ ID NO: 66618 - RNA, 1701 nt, Artificial Sequence
  derived and/or modified sequence opt1 from hemagglutinin__InfluenzaA__ADM14655
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgugcggagcaccaagcugcgccucgcgaccggccugcggaacgucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66619 - RNA, 1701 nt, Artificial Sequence
  derived and/or modified sequence opt1 from hemagglutinin__InfluenzaA__ADM14664
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66620 - RNA, 1701 nt, Artificial Sequence; identical to SEQ ID NO: 63677
  derived and/or modified sequence opt1 from hemagglutinin__InfluenzaA__ADM14673

SEQ ID NO: 66621 - RNA, 1701 nt, Artificial Sequence; identical to SEQ ID NO: 63677
  derived and/or modified sequence opt1 from hemagglutinin__InfluenzaA__ADM14682

SEQ ID NO: 66622 - RNA, 1701 nt, Artificial Sequence; identical to SEQ ID NO: 63677
  derived and/or modified sequence opt1 from hemagglutinin__InfluenzaA__ADM14691

SEQ ID NO: 66623 - RNA, 1701 nt, Artificial Sequence; identical to SEQ ID NO: 64841
  derived and/or modified sequence opt1 from hemagglutinin__InfluenzaA__ADM14700

SEQ ID NO: 66624 - RNA, 1695 nt, Artificial Sequence
  derived and/or modified sequence opt1 from hemagglutinin__InfluenzaA__ADM14709
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccaacagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcaaguacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacggcaucaccaacaagaucaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccugaacuaccacgacuccaacgugaagaaccucuacgagaaggugcggagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacagcaccguggccuccagccugguccucguggugagccugggcgccaucuccuucuggaugugcagcggccacuccugccgcaucugcaucuga

SEQ ID NO: 66625 - RNA, 1701 nt, Artificial Sequence
  derived and/or modified sequence opt1 from hemagglutinin__InfluenzaA__ADM14718
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccaugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66626 - RNA, 1695 nt, Artificial Sequence
  derived and/or modified sequence opt1 from hemagglutinin__InfluenzaA__ADM14728
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaacagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccggccacagcugccggaucugcaucuga

SEQ ID NO: 66627 - RNA, 1701 nt, Artificial Sequence
  derived and/or modified sequence opt1 from hemagglutinin__InfluenzaA__ADM14737
augaaggccauccuggugguccuccuguacaccuucgccaccgcgaacgccgacacgcugugcaucggcuaccacgccaacaacagcaccgacaccgugaacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66628 - RNA, 1701 nt, Artificial Sequence
  derived and/or modified sequence opt1 from hemagglutinin__InfluenzaA__ADM14746
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcugggugcuggggaacccggagugcgagagccuguccaccgcgagcuccuggagcuacaucguggagacccccuccagcgacaacggcacgugcuaccccggcgacuucaucgacuacgaggagcuccgggagcagcuguccagcgucuccagcuucgagcgcuucgagaucuuccccaagaccuccagcuggccgaaccacgacuccaacaagggggugaccgccgccugcccccacgccggcgccaagagcuucuacaagaaccugaucuggcucgugaagaaggggaacuccuaccccaagcugagcaaguccuacaucaacgacaagggcaaggagguccuggugcucugggggauccaccaccccagcaccagcgccgaccagcagucccuguaccagaacgccgacgccuacguguucgucggcacgagccgguacuccaagaaguucaagccggagaucgccauccgccccaaggugcgggaccaggagggccgcaugaacuacuacuggacccugguggagcccggggacaagaucaccuucgaggcgaccggcaaccucgucgugccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgucaaguccaagaagcugcggcucgcgaccggccugcgcaacgugcccagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 66629 - RNA, 1695 nt, Artificial Sequence
  derived and/or modified sequence opt1 from hemagglutinin__InfluenzaA__ADM14756
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccggccacagcugccggaucugcaucuga

SEQ ID NO: 66630 - RNA, 1701 nt, Artificial Sequence; identical to SEQ ID NO: 64841
  derived and/or modified sequence opt1 from hemagglutinin__InfluenzaA__ADM14765

SEQ ID NO: 66631 - RNA, 1695 nt, Artificial Sequence
  derived and/or modified sequence opt1 from hemagglutinin__InfluenzaA__ADM14775
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucggggagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcggccacuccugccggaucugcaucuga

SEQ ID NO: 66632 - RNA, 1695 nt, Artificial Sequence
  derived and/or modified sequence opt1 from hemagglutinin__InfluenzaA__ADM14802
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagauccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccggccacagcugccggaucugcaucuga

SEQ ID NO: 66633 - RNA, 1704 nt, Artificial Sequence
  derived and/or modified sequence opt1 from hemagglutinin__InfluenzaA__ADM14830
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgagagcgggaucaucaucuccgacacgcccgugcacgacugcaacacgaccugccagaccccgaagggcgccaucaacaccagccugcccuuccagaacauccaccccaucaccaucggcaagugccccaaguacgugaaguccaccaagcuccggcuggcgaccgggcugcgcaacgucccgagcauccagucccggggccucuucggggccaucgccggcuucaucgagggcggguggacgggcaugguggacgggugguacggcuaccaccaccagaacgagcaggggagcggcuacgccgccgaccugaaguccacccagaacgcgaucgacgagaucaccaacaaggugaacagcgucaucgagaagaugaacacccaguucacggccguggggaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaagcuguacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgggaggagaucgacggggugaagcuggaguccacccgcaucuaccagauccuggcgaucuacagcaccgucgccuccagccucgugcugguggucagccugggcgccaucuccuucuggaugugcagcgggcacuccugccuccagugccggaucugcaucuga

SEQ ID NO: 66634 - RNA, 1695 nt, Artificial Sequence
  derived and/or modified sequence opt1 from hemagglutinin__InfluenzaA__ADM14848
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcggccacuccugccggaucugcaucuga

SEQ ID NO: 66635 - RNA, 1695 nt, Artificial Sequence
  derived and/or modified sequence opt1 from hemagglutinin__InfluenzaA__ADM14866
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaucaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccggccacagcugccggaucugcaucuga

SEQ ID NO: 66636 - RNA, 1695 nt, Artificial Sequence
  derived and/or modified sequence opt1 from hemagglutinin__InfluenzaA__ADM14876
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaaggagaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccgggcacagcugccggaucugcaucuga

SEQ ID NO: 66637 - RNA, 1704 nt, Artificial Sequence
  derived and/or modified sequence opt1 from hemagglutinin__InfluenzaA__ADM14885
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaaggagaaggaggugcucguccuguggggcauccaccaccccagcaccagcgccgaccagcagucccuguaccagaacgccgacgccuacguguucguggggacgagccgguacuccaagaaguucaagcccgagaucgucauccgcccgaaggugcgggaccaggagggccgcaugaacuacuacuggacccucguggagcccggcgacaagaucaccuucgaggccaccgggaaccuggucgugccccgguacgcguucgccauggagcgcaacgccgagagcggcaucaucaucuccgacacgcccgugcacgacugcaacacgaccugccagaccccgaagggggccaucaacaccagccugcccuuccagaacauccaccccaucaccaucggcaagugccccaaguacgucaaguccaccaagcuccggcuggccaccggccugcgcaacgugccgagcauccagucccggggccucuucggggcgaucgccggguucaucgagggcggguggacgggcaugguggacggcugguacggguaccaccaccagaacgagcagggcagcggguacgccgccgaccugaaguccacccagaacgccaucgacgagaucaccaacaaggucaacagcgugaucgagaagaugaacacccaguucacggcggucggcaaggaguucaaccaccuggagaagcgcaucgagaaccucaacaagaagguggacgacggguuccuggacaucuggaccuacaacgccgagcugcucgugcugcuggagaacgagcggacccucgacuaccacgacuccaacgucaagaagcuguacgagaaggugcgcagccagcugaagaacaacgccaaggagaucggcaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggccaucuacagcaccguggcguccagccucgugcuggucgugagccugggggccaucuccuucuggaugugcagcggccacgggucccuccagugccggaucugcaucuga

SEQ ID NO: 66638 - RNA, 1695 nt, Artificial Sequence
  derived and/or modified sequence opt1 from hemagglutinin__InfluenzaA__ADM14894
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaaggagaaggaggugcugguccucuggggcauccaccaccccagcaccuccgccgaccagcagagccuguaccagaacgccgacgccuacguguucguggggacgucccgguacagcaagaaguucaagcccgagaucgucauccgcccgaaggugcgggaccaggagggccgcaugaacuacuacuggacccugguggagcccggcgacaagaucaccuucgaggccaccgggaaccucgucgugccccgguacgcguucgccauggagcgcaacgccggcuccgggaucgugaucagcgacacgcccguccacgacugcaacacgaccugccagaccccgaagggcgccaucaacaccucccugcccuuccagaacauccaccccaucaccaucggcaagugccccaaguacgucaagagcaccaagcugcggcucgccaccgggcugcgcaacgugccguccauccagagccggggccuguucggggcgaucgccggcuucaucgagggcggguggacgggcaugguggacgggugguacggcuaccaccaccagaacgagcagggguccggcuacgccgccgaccucaagagcacccagaacgccaucgacgagaucaccaacaaggugaacuccgucaucgagaagaugaacacccaguucacggcgguggggaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaagcucuacgagaaggugcgcucccagcugaagaacaacgccaaggagaucggcaacgggugcuucgaguucuaccacaagugcgacaacacgugcaugaaguccgucaagaacggcaccuacgacuaccccaaguacagcgaggaggccaagcugaaccgggaggagaucgacggggugaagcucgagagcacccgcaucuaccagauccuggccaucuacuccaccguggcgagcagccugguccucguggugucccugggcgccaucagcuucuggaugugcuccgggcacagcugccggaucugcaucuga

SEQ ID NO: 66639 - RNA, 1695 nt, Artificial Sequence
  derived and/or modified sequence opt1 from hemagglutinin__InfluenzaA__ADM14903
augaaggccauccuggugguccuccugugcaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccggccacagcugccggaucugcaucuga

SEQ ID NO: 66640 - RNA, 1695 nt, Artificial Sequence
  derived and/or modified sequence opt1 from hemagglutinin__InfluenzaA__ADM14912
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccggccacagcugccggaucugcaucuga

SEQ ID NO: 66641 - RNA, 1695 nt, Artificial Sequence
  derived and/or modified sequence opt1 from hemagglutinin__InfluenzaA__ADM14921
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccggccacagcugccggaucugcaucuga

SEQ ID NO: 66642 - RNA, 1701 nt, Artificial Sequence; identical to SEQ ID NO: 64841
  derived and/or modified sequence opt1 from hemagglutinin__InfluenzaA__ADM14930

SEQ ID NO: 66643 - RNA, 1701 nt, Artificial Sequence
  derived and/or modified sequence opt1 from hemagglutinin__InfluenzaA__ADM14948
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacucccgcaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccgacacgcccgugcacgacugcaacacgaccugccagaccccggagggggccaucaacaccagccugcccuuccagaacauccaccccaucaccaucggcaagugccccaaguacgugaaguccaccaagcugcgccucgcgaccgggcugcggaacgucccgagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccuccagccuggugcucguggucagccugggcgccaucuccuucuggaugugcagcaacggcucccugcagugccgcaucugcaucuga

SEQ ID NO: 66644 - RNA, 1695 nt, Artificial Sequence
  derived and/or modified sequence opt1 from hemagglutinin__InfluenzaA__ADM14966
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcggccacuccugccggaucugcaucuga

SEQ ID NO: 66645 - RNA, 1701 nt, Artificial Sequence; identical to SEQ ID NO: 63857
  derived and/or modified sequence opt1 from hemagglutinin__InfluenzaA__ADM14975

SEQ ID NO: 66646 - RNA, 1701 nt, Artificial Sequence
  derived and/or modified sequence opt1 from hemagglutinin__InfluenzaA__ADM14985
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaaggagaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccggggccaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccacagcaucaccaucgggaagugccccaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 66647 - RNA, 1701 nt, Artificial Sequence
  derived and/or modified sequence opt1 from hemagglutinin__InfluenzaA__ADM23841
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccagagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66648 - RNA, 1701 nt, Artificial Sequence; identical to SEQ ID NO: 64841
  derived and/or modified sequence opt1 from hemagglutinin__InfluenzaA__ADM23843

SEQ ID NO: 66649 - RNA, 1701 nt, Artificial Sequence
  derived and/or modified sequence opt1 from hemagglutinin__InfluenzaA__ADM23844
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccaccgccugcccgcacgccggcgccaagggguucuacaagaaccugaucuggcucgugaagaagggcaacagcuaccccaagcuguccaagagcuacaucaacgacaaggggaaggaggugcugguccucuggggcauccaccaccaguccacgagcgcggaccagcagagccuguaccagaacgccgacgccuacguguucgugggcaccucccgguacagcaagaaguucaagcccgagaucgccauccgccccaagguccgggaccaggaggggcgcaugaacuacuacuggacccugguggagccgggcgacaagaucaccuucgaggccacggggaaccucguggucccccgguacgcguucgccauggagcgcaacgccggcuccggcaucaucaucagcgacacccccgugcacgacugcaacacgaccugccagacccccaagggggccaucaacaccucccugccguuccagaacauccaccccaucaccaucggcaagugccccaaguacgucaagagcaccaagcugcggcucgccacggggcugcgcaacgugcccuccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuacccgaaguacuccgaggaggccaagcugaaccgggaggagaucgacggggugaagcucgagagcacccgcaucuaccagauccuggccaucuacuccaccgucgcgagcucccuggugcucguggucagccugggcgccaucagcuucuggaugugcuccaacggcagccugcagugccggaucugcaucuga

SEQ ID NO: 66650 - RNA, 1701 nt, Artificial Sequence
  derived and/or modified sequence opt1 from hemagglutinin__InfluenzaA__ADM23845
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccaccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccagagcacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagccgggggacaagaucaccuucgaggccacgggcaaccucguggucccccgguacgcguucgccauggagcgcaacgccgggagcggcaucaucaucuccgacacccccgugcacgacugcaacacgaccugccagacccccaagggcgccaucaacaccagccugccguuccagaacauccaccccaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 66651 - RNA, 1701 nt, Artificial Sequence
  derived and/or modified sequence opt1 from hemagglutinin__InfluenzaA__ADM23846
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccaccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcacgagcgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 66652 - RNA, 1701 nt, Artificial Sequence
  derived and/or modified sequence opt1 from hemagglutinin__InfluenzaA__ADM23847
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccaccgccugcccgcacgccggcgccaagggguucuacaagaaccugaucuggcucgugaagaagggcaacagcuaccccaagcuguccaagagcuacaucaacgacaaggggaaggaggugcugguccucuggggcauccaccaccaguccacgagcgcggaccagcagagccuguaccagaacgccgacgccuacguguucgugggcaccucccgguacagcaagaaguucaagcccgagaucgccauccgccccaagguccgggaccaggaggggcgcaugaacuacuacuggacccugguggagccgggcgacaagaucaccuucgaggccacggggaaccucguggucccccgguacgcguucgccauggagcgcaacgugggcuccggcaucaucaucagcgacacccccgugcacgacugcaacacgaccugccagacccccaagggggccaucaacaccucccugccguuccagaacauccaccccaucaccaucggcaagugccccaaguacgucaagagcaccaagcugcggcucgccacggggcugcgcaacgugcccuccauccagagccggggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucaccaacaaggucaacuccgugaucgagaagaugaacacgcaguucaccgccgucggcaaggaguucaaccaccuggagaagcgcaucgagaaccugaacaagaagguggacgacggguuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuacccgaaguacuccgaggaggccaagcugaaccgggaggagaucgacggggucaagcucgagagcacccgcaucuaccagauccuggccaucuacuccaccguggccagcucccuggugcucgucgugagccugggcgcgaucagcuucuggaugugcuccaacggcagccugcagugccggaucugcaucuga

SEQ ID NO: 66653 - RNA, 1701 nt, Artificial Sequence
  derived and/or modified sequence opt1 from hemagglutinin__InfluenzaA__ADM23849
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccagagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66654 - RNA, 1701 nt, Artificial Sequence
  derived and/or modified sequence opt1 from hemagglutinin__InfluenzaA__ADM23851
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccagagcaccuccgccgaccagcagagccuguaccagaacgccgacgccuacguguucgugggcuccagccgguacuccaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccgggagcggcaucaucaucuccgacacccccgugcacgacugcaacacgaccugccagacccccaagggcgccaucaacaccagccugccguuccacaacauccaccccaucacgaucgggaagugccccaaguacgugaaguccaccaagcugcggcucgcgaccggccugcgcaacguccccagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggagaagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 66655 - RNA, 1701 nt, Artificial Sequence
  derived and/or modified sequence opt1 from hemagglutinin__InfluenzaA__ADM23852
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 66656 - RNA, 1701 nt, Artificial Sequence; identical to SEQ ID NO: 66655
  derived and/or modified sequence opt1 from hemagglutinin__InfluenzaA__ADM23853

SEQ ID NO: 66657 - RNA, 1701 nt, Artificial Sequence; identical to SEQ ID NO: 63919
  derived and/or modified sequence opt1 from hemagglutinin__InfluenzaA__ADM23855

SEQ ID NO: 66658 - RNA, 1701 nt, Artificial Sequence
  derived and/or modified sequence opt1 from hemagglutinin__InfluenzaA__ADM23856
augaaggccauccuggugguccuccuguacaccuucgccaccgugaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagcggaaggagguccuggugcucuggggcauccaccaccagagcaccuccgcggaccagcagagccuguaccagaacgccgacgccuacguguucgucgggacgucccgcuacagcaagaaguucaagcccgagaucgccauccggcccaaggugcgcgaccaggagggccggaugaacuacuacuggacccugguggagccgggcgacaagaucaccuucgaggccaccgggaaccucgucgugccccgcuacgcguucgccauggagcggaacgccggcuccgggaucaucaucagcgacacgcccgugcacgacugcaacacgaccugccagacccccaagggcgccaucaacaccucccugccguuccagaacauccaccccaucaccaucggcaagugccccaaguacgucaagagcaccaagcugcgccucgccaccgggcugcggaacgugcccuccauccagagccgcggccuguucggggcgaucgccggcuucaucgagggcggguggacgggcaugguggacgggugguacggcuaccaccaccagaacgagcagggguccggcuacgccgccgaccucaagagcacccagaacgccaucgacaagaucaccaacaaggucaacuccgugaucgagaagaugaacacccaguucacggcggucgggaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucggcaacgggugcuucgaguucuaccacaagugcgacaacacgugcauggagagcgugaagaacggcaccuacgacuacccgaaguacuccgaggaggccaagcugaaccgcgaggagaucgacggggucaagcucgagagcacccggaucuaccagauccuggccaucuacuccaccguggcgagcagccuggugcucgucgugucccugggcgccaucagcuucuggaugugcuccaacgggagccugcagugccgcaucugcaucuga

SEQ ID NO: 66659 - RNA, 1701 nt, Artificial Sequence; identical to SEQ ID NO: 63677
  derived and/or modified sequence opt1 from hemagglutinin__InfluenzaA__ADM25945

SEQ ID NO: 66660 - RNA, 1701 nt, Artificial Sequence; identical to SEQ ID NO: 63919
  derived and/or modified sequence opt1 from hemagglutinin__InfluenzaA__ADM25948

SEQ ID NO: 66661 - RNA, 1701 nt, Artificial Sequence; identical to SEQ ID NO: 65706
  derived and/or modified sequence opt1 from hemagglutinin__InfluenzaA__ADM26264

SEQ ID NO: 66662 - RNA, 1701 nt, Artificial Sequence; identical to SEQ ID NO: 65706
  derived and/or modified sequence opt1 from hemagglutinin__InfluenzaA__ADM26265

SEQ ID NO: 66663 - RNA, 1701 nt, Artificial Sequence; identical to SEQ ID NO: 65706
  derived and/or modified sequence opt1 from hemagglutinin__InfluenzaA__ADM26266

SEQ ID NO: 66664 - RNA, 1701 nt, Artificial Sequence; identical to SEQ ID NO: 65706
  derived and/or modified sequence opt1 from hemagglutinin__InfluenzaA__ADM26267

SEQ ID NO: 66665 - RNA, 1701 nt, Artificial Sequence
  derived and/or modified sequence opt1 from hemagglutinin__InfluenzaA__ADM26268
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaagcgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 66666 - RNA, 1701 nt, Artificial Sequence
  derived and/or modified sequence opt1 from hemagglutinin__InfluenzaA__ADM26269
augaagaccauccuggugguccuccuguacaccuucacgaccgccaacgccgacacccugugcaucggcuaccacgcgaacaacagcaccgacacgguggacaccgugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccacggccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucacggccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgcggacgccuacguguucgugggcaccucccgguacagcaagaaguucaagcccgagaucgccauccgcccgaagguccgggagcaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccacagcaucaccaucgggaagugccccaaguacgugaaguccacgaagcugcggcucgccaccggccugcgcaacguccccagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucacgaacaaggugaacagcgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaagcgggaggagaucgacggcgugaagcucgaguccacccgcaucuaccagauccuggccaucuacagcaccgucgccagcucccuggugcucguggucagccugggggcgaucuccuucuggaugugcagcaacggcucccugcagugccggaucugcaucuga

SEQ ID NO: 66667 - RNA, 1701 nt, Artificial Sequence
  derived and/or modified sequence opt1 from hemagglutinin__InfluenzaA__ADM26270
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggcggugccccaaguacgugaaguccaccaagcugcgccucgccacgggccugcggaacguccccagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggaccaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 66668 - RNA, 1701 nt, Artificial Sequence; identical to SEQ ID NO: 65706
  derived and/or modified sequence opt1 from hemagglutinin__InfluenzaA__ADM26271

SEQ ID NO: 66669 - RNA, 1701 nt, Artificial Sequence
  derived and/or modified sequence opt1 from hemagglutinin__InfluenzaA__ADM26272
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggcggugccccaaguacgugaaguccaccaagcugcgccucgccacgggccugcggaacguccccagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 66670 - RNA, 1701 nt, Artificial Sequence
  derived and/or modified sequence opt1 from hemagglutinin__InfluenzaA__ADM26274
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaaggaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 66671 - RNA, 1701 nt, Artificial Sequence; identical to SEQ ID NO: 65706
  derived and/or modified sequence opt1 from hemagglutinin__InfluenzaA__ADM26276

SEQ ID NO: 66672 - RNA, 1701 nt, Artificial Sequence
  derived and/or modified sequence opt1 from hemagglutinin__InfluenzaA__ADM26277
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggccaucuacagcaccgucgcgagcucccuggugcucaucgugagccugggggccaucuccuucuggaugugcagcaacggcucccugcagugccggaucugcaucuga

SEQ ID NO: 66673 - RNA, 1701 nt, Artificial Sequence
  derived and/or modified sequence opt1 from hemagglutinin__InfluenzaA__ADM26278
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguccgugggcaccagccgguacuccaagaaguucaagcccgagaucgccauccgcccgaagguccgggagcaggagggccgcaugaacuacuacuggacccugguggagcccggggacaagaucaccuucgaggccacgggcaaccucguggucccccgguucgcguucgccauggagcgcaacgccgggagcggcaucaucaucuccgacacccccgugcacgacugcaacacgaccugccagaccccgaagggcgccaucaacaccagccugcccuuccagaacauccacuccaucaccaucgggaagugccccaaguacgucaagagcaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaagcgggaggagaucgacggcgugaagcucgagagcacccgcaucuaccagauccuggccaucuacagcaccgucgcguccagccuggugcucguggucucccugggggccaucagcuucuggaugugcuccaacggcagccugcagugccggaucugcaucuga

SEQ ID NO: 66674 - RNA, 1701 nt, Artificial Sequence
  derived and/or modified sequence opt1 from hemagglutinin__InfluenzaA__ADM26279
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccggggccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccacagcaucaccaucggcaagugccccaaguacgugaaguccaccaagcugcggcucgccacggggcugcgcaacguccccagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacagcgaggaggccaagcugaaccgggaggagaucgacggggugaagcucgaguccacccgcaucuaccagauccuggccaucuacagcaccgucgcgagcucccuggugcucguggucagccugggcgccaucuccuucuggaugugcagcaacggcucccugcagugccggaucugcaucuga

SEQ ID NO: 66675 - RNA, 1701 nt, Artificial Sequence; identical to SEQ ID NO: 65706
  derived and/or modified sequence opt1 from hemagglutinin__InfluenzaA__ADM26280

SEQ ID NO: 66676 - RNA, 1701 nt, Artificial Sequence
  derived and/or modified sequence opt1 from hemagglutinin__InfluenzaA__ADM26281
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagagcauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagcgccggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccgggucuaccagauccuggcgaucuacagcaccguggccagcucccuggugcucgucgugagccugggggccaucuccuucuggaugugcagcaacggcucccugcagugccgcaucugcaucuga

SEQ ID NO: 66677 - RNA, 1701 nt, Artificial Sequence
  derived and/or modified sequence opt1 from hemagglutinin__InfluenzaA__ADM26282
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagcgccggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 66678 - RNA, 1701 nt, Artificial Sequence
  derived and/or modified sequence opt1 from hemagglutinin__InfluenzaA__ADM26283
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccacagcaucaccaucgggaagugccccaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggagaagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 66679 - RNA, 1701 nt, Artificial Sequence; identical to SEQ ID NO: 65706
  derived and/or modified sequence opt1 from hemagglutinin__InfluenzaA__ADM26284

SEQ ID NO: 66680 - RNA, 1701 nt, Artificial Sequence; identical to SEQ ID NO: 65706
  derived and/or modified sequence opt1 from hemagglutinin__InfluenzaA__ADM26285

SEQ ID NO: 66681 - RNA, 1701 nt, Artificial Sequence
  derived and/or modified sequence opt1 from hemagglutinin__InfluenzaA__ADM26784
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaugcgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 66682 - RNA, 1701 nt, Artificial Sequence; identical to SEQ ID NO: 63442
  derived and/or modified sequence opt1 from hemagglutinin__InfluenzaA__ADM26795

SEQ ID NO: 66683 - RNA, 1701 nt, Artificial Sequence
  derived and/or modified sequence opt1 from hemagglutinin__InfluenzaA__ADM26817
augaagaccaccaucgcccugagccacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgccggcgcgcguacagcaacugcuaccccuacgacgugccggacuacgccucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgagugcaucacccccaacggcagcauccccaacgacaagccguuccagaacgugaaccgcaucacguacggggccugcccccgguacgucaagcaguccacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcucaagagcggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 66684 - RNA, 1704 nt, Artificial Sequence
  derived and/or modified sequence opt1 from hemagglutinin__InfluenzaA__ADM31424
auggagaagaucgugcuccuguucaccaccaucagccuggucaaguccgaccacaucugcaucggcuaccacgccaacaacagcacggagcaggucgacaccaucauggagaagaacgugaccgugacccacgcccaggacauccuggagaagacgcacaacgggaagcucugcgaccugaacggcgugaagccccugauccucaaggacugcuccguggcgggguggcugcugggcaacccgcucugcgacgaguucaucaacguccccgaguggagcuacaucguggagaaggccaaccccgccaacgaccugugcuaccccgggaacuucaacgacuacgaggagcugaagcaccuccugucccgcaucaaccacuucgagaagauccagaucaucccgaaggacagcugguccgaccacgaggccagccugggcguguccgccgcgugcagcuaccagggcaacuccagcuucuuccggaacgucguguggcucaucaagaaggacaacgccuaccccaccaucaagaaggacuacaacaacaccaaccaggaggaccugcuggugcucugggggauccaccaccccaacgacgaggccgagcagacccgccuguaccagaaccccacgaccuacaucuccaucggcaccagcacccugaaccagcggcucgucccgaagaucgccacgcgcuccaagaucaacgggcagagcggccggaucgacuucuucuggaccauccugaagcccaacgacgcgauccacuucgaguccaacgggaacuucaucgcccccgaguacgccuacaagaucgugaagaagggcgacagcaccaucaugaaguccgagguggaguacggcaacugcaacacccgcugccagacgcccaucggggccaucaacagcagcaugccguuccacaacauccacccccugaccaucggcgagugccccaaguacgucaaguccaacaagcucgugcuggccaccgggcugcggaacagcccccagcgcgagcggcgccggaagcgcggccucuucggcgcgaucgccggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggcgguggggcgggaguucaacaaccuggagcgccggaucgagaaccugaacaagaagauggaggacggcuuccucgacgucuggaccuacaacgccgagcugcuggugcucauggagaacgagcgcacccuggacuuccacgacuccaacgugaagaaccuguacgacaagguccggcuccagcugaaggacaacgccaaggagcuggggaacggcugcuucgaguucuaccacaagugcaacaacgagugcauggagagcgugcgcaacggcacguacgacuacccgcaguacuccgaggaggcccggcucaagcgcgaggagaucagcggggucaagcuggaguccaucggcaucuaccagauccugagcaucuacuccaccguggccagcucccucgugcuggcgaucaugauggccgggcugagccucuggaugugcuccaacggcagccugcagugccggaucugcaucuga

SEQ ID NO: 66685 - RNA, 1701 nt, Artificial Sequence; identical to SEQ ID NO: 66278
  derived and/or modified sequence opt1 from hemagglutinin__InfluenzaA__ADM31478

SEQ ID NO: 66686 - RNA, 1701 nt, Artificial Sequence
  derived and/or modified sequence opt1 from hemagglutinin__InfluenzaA__ADM31488
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccugguggucccccgcuacgccuucgccauggagcggaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcgccuggcgaccggccuccggaacgucccgagcauccagucccgcgggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgcgaggagaucgacggcgucaagcuggaguccacccggaucuaccagauccucgcgaucuacagcaccgccgccagcucccuggugcugguggucagccucggggccaucuccuucuggaugugcagcaacggcucccugcagugccgcaucugcaucuga

SEQ ID NO: 66687 - RNA, 1701 nt, Artificial Sequence
  derived and/or modified sequence opt1 from hemagglutinin__InfluenzaA__ADM31498
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccuggugaagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66688 - RNA, 1701 nt, Artificial Sequence
  derived and/or modified sequence opt1 from hemagglutinin__InfluenzaA__ADM31508
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagacccggagcuggcccaaccacgacuccaacaagggggucaccgccgccugcccgcacgccggcgccaagagcuucuacaagucccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66689 - RNA, 1701 nt, Artificial Sequence
  derived and/or modified sequence opt1 from hemagglutinin__InfluenzaA__ADM31518
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacgugaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66690 - RNA, 1701 nt, Artificial Sequence
  derived and/or modified sequence opt1 from hemagglutinin__InfluenzaA__ADM31528
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66691 - RNA, 1701 nt, Artificial Sequence
  derived and/or modified sequence opt1 from hemagglutinin__InfluenzaA__ADM31538
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66692 - RNA, 1701 nt, Artificial Sequence
  derived and/or modified sequence opt1 from hemagglutinin__InfluenzaA__ADM31548
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgaggucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66693 - RNA, 1701 nt, Artificial Sequence
  derived and/or modified sequence opt1 from hemagglutinin__InfluenzaA__ADM31558
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagauccggaacgggugcuucgaguucuaccacaagugcgacaacacgugcauggagagcgucaagaacggcaccuacgacuaccccaaguacuccgaggaggccaagcugaaccgcgaggagaucgacggggugaagcucgagagcacccggaucuaccagauccuggcgaucuacuccaccguggccagcagccugguccucguggugucccugggcgccaucagcuucuggaugugcuccaacgggagccugcagugccgcaucugcaucuga

SEQ ID NO: 66694 - RNA, 1701 nt, Artificial Sequence; identical to SEQ ID NO: 65274
  derived and/or modified sequence opt1 from hemagglutinin__InfluenzaA__ADM31568

SEQ ID NO: 66695 - RNA, 1701 nt, Artificial Sequence; identical to SEQ ID NO: 63677
  derived and/or modified sequence opt1 from hemagglutinin__InfluenzaA__ADM31578

SEQ ID NO: 66696 - RNA, 1701 nt, Artificial Sequence
  derived and/or modified sequence opt1 from hemagglutinin__InfluenzaA__ADM31588
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggugaccgccgccugcccgcacgccggcgcgaaguccuucuacaagaaccugaucuggcucgucaagaaggggaacagcuaccccaagcugaacaaguccuacaucaacgacaagggcaaggaggugcuggugcucugggggauccaccaccccagcaccagcgccgaccagcagucccuguaccagaacgccgacgccuacgucuucgugggcacgagccgguacuccaagaaguucaagaccgagaucgccauccgccccaaggugcgggaccaggagggccgcaugaacuacuacuggacccuggucgagccgggggacaagaucaccuucgaggcgacgggcaaccucguggugccccgguacgccuucgccauggagcgcaacgccgggagcggcaucaucaucuccgacacccccguccacgacugcaacacgaccugccagacccccaagggcgccaucaacaccagccugccguuccagaacauccaccccaucaccaucgggaagugccccaaguacgugaaguccaccaagcugcggcucgcgacgggccugcgcaacgugcccagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggaggucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66697 - RNA, 1701 nt, Artificial Sequence
  derived and/or modified sequence opt1 from hemagglutinin__InfluenzaA__ADM31598
augaacgccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcgacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccgaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuaccacuggacccucgucgagcccggggacaagaucaccuucgaggcgaccggcaaccugguggugccccgguacgccuucgccauggagcgcaacgccggguccggcaucaucaucagcgacgcccccguccacgacugcaacacgaccugccagaccccgaagggcgcgaucaacaccucccugcccuuccagaacauccaccccaucacgaucgggaagugccccaaguacgucaagagcaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaagaucaacuccgugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgggaggagaucgacggcgucaagcuggagagcacccgcaucuaccagauccuggccaucuacuccaccguggccagcagccucgugcuggucgugucccugggggccaucagcuucuggaugugcuccaacggcagccuccagugccggaucugcaucuga

SEQ ID NO: 66698 - RNA, 1701 nt, Artificial Sequence
  derived and/or modified sequence opt1 from hemagglutinin__InfluenzaA__ADM31608
augaaggccauccuggugguccuccuguacaccuucgccaccgugaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 66699 - RNA, 1701 nt, Artificial Sequence; identical to SEQ ID NO: 65229
  derived and/or modified sequence opt1 from hemagglutinin__InfluenzaA__ADM31618

SEQ ID NO: 66700 - RNA, 1701 nt, Artificial Sequence; identical to SEQ ID NO: 64841
  derived and/or modified sequence opt1 from hemagglutinin__InfluenzaA__ADM31628

SEQ ID NO: 66701 - RNA, 1701 nt, Artificial Sequence; identical to SEQ ID NO: 66580
  derived and/or modified sequence opt1 from hemagglutinin__InfluenzaA__ADM31638

SEQ ID NO: 66702 - RNA, 1701 nt, Artificial Sequence; identical to SEQ ID NO: 65097
  derived and/or modified sequence opt1 from hemagglutinin__InfluenzaA__ADM31648

SEQ ID NO: 66703 - RNA, 1701 nt, Artificial Sequence; identical to SEQ ID NO: 65844
  derived and/or modified sequence opt1 from hemagglutinin__InfluenzaA__ADM31658

SEQ ID NO: 66704 - RNA, 1701 nt, Artificial Sequence; identical to SEQ ID NO: 65097
  derived and/or modified sequence opt1 from hemagglutinin__InfluenzaA__ADM31668

SEQ ID NO: 66705 - RNA, 1701 nt, Artificial Sequence; identical to SEQ ID NO: 63677
  derived and/or modified sequence opt1 from hemagglutinin__InfluenzaA__ADM31688

SEQ ID NO: 66706 - RNA, 1701 nt, Artificial Sequence
  derived and/or modified sequence opt1 from hemagglutinin__InfluenzaA__ADM31698
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugauccucgucgugucccugggggccaucagcuucuggaugugcuccaacggcagccugcagugccggaucugcaucuga

SEQ ID NO: 66707 - RNA, 1701 nt, Artificial Sequence; identical to SEQ ID NO: 66582
  derived and/or modified sequence opt1 from hemagglutinin__InfluenzaA__ADM31708

SEQ ID NO: 66708 - RNA, 1701 nt, Artificial Sequence
  derived and/or modified sequence opt1 from hemagglutinin__InfluenzaA__ADM31718
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66709 - RNA, 1701 nt, Artificial Sequence
  derived and/or modified sequence opt1 from hemagglutinin__InfluenzaA__ADM31728
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgugaccgccgccugcccgcacgccggggcgaaguccuucuacaagaaccugaucuggcucgucaagaagggcaacagcuaccccaagcuguccaagagcuacaucaacgacaaggggaaggaggugcuggugcucuggggcauccaccaccccagcaccuccgccgaccagcagagccuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucacgagcgacacccccguccacgacugcaacacgaccugccagaccccgaagggggccaucaacaccucccugcccuuccagaacauccaccccaucaccaucggcaagugccccaaguacgucaagagcaccaagcugcggcucgcgacggggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacccagaacgcgaucgacgagaucaccaacaaggugaacuccgugaucgagaagaugaacacgcaguucaccgccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 66710 - RNA, 1701 nt, Artificial Sequence
  derived and/or modified sequence opt1 from hemagglutinin__InfluenzaA__ADM31738
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgcgguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagcggaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagagcacccggaucuaccagauccucgcgaucuacuccaccgucgccagcagccuggugcugguggucucccucggggccaucagcuucuggaugugcuccaacggcagccugcagugccgcaucugcaucuga

SEQ ID NO: 66711 - RNA, 1701 nt, Artificial Sequence; identical to SEQ ID NO: 65326
  derived and/or modified sequence opt1 from hemagglutinin__InfluenzaA__ADM31748

SEQ ID NO: 66712 - RNA, 1701 nt, Artificial Sequence
  derived and/or modified sequence opt1 from hemagglutinin__InfluenzaA__ADM31758
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccugaucgaccccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccguggccagcagccuggugcuggucgugucccucggggccaucagcuucuggaugugcuccaacggcagccugcagugccggaucugcaucuga

SEQ ID NO: 66713 - RNA, 1701 nt, Artificial Sequence; identical to SEQ ID NO: 64037
  derived and/or modified sequence opt1 from hemagglutinin__InfluenzaA__ADM31768

SEQ ID NO: 66714 - RNA, 1701 nt, Artificial Sequence; identical to SEQ ID NO: 63677
  derived and/or modified sequence opt1 from hemagglutinin__InfluenzaA__ADM31778

SEQ ID NO: 66715 - RNA, 1701 nt, Artificial Sequence; identical to SEQ ID NO: 65844
  derived and/or modified sequence opt1 from hemagglutinin__InfluenzaA__ADM31798

SEQ ID NO: 66716 - RNA, 1701 nt, Artificial Sequence
  derived and/or modified sequence opt1 from hemagglutinin__InfluenzaA__ADM31808
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugcucuggcuggugaagaagggcaacagcuaccccaagcuguccaagagcuacaucaacgacaaggggaaggaggugcucguccuguggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccucgugggccccggggacaagaucaccuucgaggcgaccggcaaccugguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggcuucaucgagggcggguggacggggaugguggacggcugguacggguaccaccaccagaacgagcagggcuccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggcgccaucagcuucuggaugugcuccaacgggagccuccagugccggaucugcaucuga

SEQ ID NO: 66717 - RNA, 1701 nt, Artificial Sequence; identical to SEQ ID NO: 65844
  derived and/or modified sequence opt1 from hemagglutinin__InfluenzaA__ADM31818

SEQ ID NO: 66718 - RNA, 1701 nt, Artificial Sequence
  derived and/or modified sequence opt1 from hemagglutinin__InfluenzaA__ADM31828
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaagggcaagagcuaccccaagcuguccaagagcuacaucaacgacaaggggaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgagcaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcuccuggugucccugggggccaucagcuucuggaugugcuccaacggcagccuccagugccgcaucugcaucuga

SEQ ID NO: 66719 - RNA, 1701 nt, Artificial Sequence; identical to SEQ ID NO: 66718
  derived and/or modified sequence opt1 from hemagglutinin__InfluenzaA__ADM31838

SEQ ID NO: 66720 - RNA, 1701 nt, Artificial Sequence; identical to SEQ ID NO: 63677
  derived and/or modified sequence opt1 from hemagglutinin__InfluenzaA__ADM31848

SEQ ID NO: 66721 - RNA, 1701 nt, Artificial Sequence
  derived and/or modified sequence opt1 from hemagglutinin__InfluenzaA__ADM31858
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugaacaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgccccaagguccgggagcaggagggccgcaugaacuacuacuggacccugguggagccgggggacaagaucaccuucgaggcgaccggcaaccucguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcguggagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66722 - RNA, 1701 nt, Artificial Sequence
  derived and/or modified sequence opt1 from hemagglutinin__InfluenzaA__ADM31868
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucaacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccuguggggcgugcaccaccccagcaccagcgccgaccagcagucccuguaccagaacgccgacgccuacguguucgucgggacgagccgguacuccaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucagcauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgucaagcuggagagcacccgcaucuaccagauccuggccaucuacuccaccguggcgagcagccucgugcuggucgugucccugggggccaucagcuucuggaugugcuccaacggcagccuccagugccggaucugcaucuga

SEQ ID NO: 66723 - RNA, 1701 nt, Artificial Sequence
  derived and/or modified sequence opt1 from hemagglutinin__InfluenzaA__ADM31878
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccugguggucccccgguacgccuucgccauggagcgcaacgccggguccggcaucaucaucagcgacacccccgugcacgacugcaacacgaccugccagaccccgaagggcgcgaucaacaccucccuccccuuccagaacauccaccccaucacgaucgggaagugccccaaguacgucaagagcaccaagcugcggcuggccaccggccuccgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcuggagagcacccgcaucuaccagauccucgccaucuacuccaccgucgccagcagccuggugcugguggucucccucggggccaucagcuucuggaugugcuccaacggcagccugcagugccggaucugcaucuga

SEQ ID NO: 66724 - RNA, 1701 nt, Artificial Sequence; identical to SEQ ID NO: 65326
  derived and/or modified sequence opt1 from hemagglutinin__InfluenzaA__ADM31888

SEQ ID NO: 66725 - RNA, 1701 nt, Artificial Sequence; identical to SEQ ID NO: 63857
  derived and/or modified sequence opt1 from hemagglutinin__InfluenzaA__ADM31898

SEQ ID NO: 66726 - RNA, 1701 nt, Artificial Sequence
  derived and/or modified sequence opt1 from hemagglutinin__InfluenzaA__ADM31908
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgaccacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 66727 - RNA, 1701 nt, Artificial Sequence; identical to SEQ ID NO: 63857
  derived and/or modified sequence opt1 from hemagglutinin__InfluenzaA__ADM31918

SEQ ID NO: 66728 - RNA, 1701 nt, Artificial Sequence; identical to SEQ ID NO: 65449
  derived and/or modified sequence opt1 from hemagglutinin__InfluenzaA__ADM31928

SEQ ID NO: 66729 - RNA, 1701 nt, Artificial Sequence; identical to SEQ ID NO: 65449
  derived and/or modified sequence opt1 from hemagglutinin__InfluenzaA__ADM31948

SEQ ID NO: 66730 - RNA, 1701 nt, Artificial Sequence; identical to SEQ ID NO: 63677
  derived and/or modified sequence opt1 from hemagglutinin__InfluenzaA__ADM31958

SEQ ID NO: 66731 - RNA, 1701 nt, Artificial Sequence; identical to SEQ ID NO: 65449
  derived and/or modified sequence opt1 from hemagglutinin__InfluenzaA__ADM31968

SEQ ID NO: 66732 - RNA, 1701 nt, Artificial Sequence; identical to SEQ ID NO: 65265
  derived and/or modified sequence opt1 from hemagglutinin__InfluenzaA__ADM31978

SEQ ID NO: 66733 - RNA, 1701 nt, Artificial Sequence; identical to SEQ ID NO: 63857
  derived and/or modified sequence opt1 from hemagglutinin__InfluenzaA__ADM31998

SEQ ID NO: 66734 - RNA, 1701 nt, Artificial Sequence; identical to SEQ ID NO: 63857
  derived and/or modified sequence opt1 from hemagglutinin__InfluenzaA__ADM32008

SEQ ID NO: 66735 - RNA, 1701 nt, Artificial Sequence
  derived and/or modified sequence opt1 from hemagglutinin__InfluenzaA__ADM32018
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcgacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66736 - RNA, 1701 nt, Artificial Sequence
  derived and/or modified sequence opt1 from hemagglutinin__InfluenzaA__ADM32028
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 66737 - RNA, 1701 nt, Artificial Sequence; identical to SEQ ID NO: 65449
  derived and/or modified sequence opt1 from hemagglutinin__InfluenzaA__ADM32038

SEQ ID NO: 66738 - RNA, 1701 nt, Artificial Sequence; identical to SEQ ID NO: 63857
  derived and/or modified sequence opt1 from hemagglutinin__InfluenzaA__ADM32048

SEQ ID NO: 66739 - RNA, 1701 nt, Artificial Sequence; identical to SEQ ID NO: 64841
  derived and/or modified sequence opt1 from hemagglutinin__InfluenzaA__ADM32058

SEQ ID NO: 66740 - RNA, 1701 nt, Artificial Sequence; identical to SEQ ID NO: 64841
  derived and/or modified sequence opt1 from hemagglutinin__InfluenzaA__ADM32068

SEQ ID NO: 66741 - RNA, 1701 nt, Artificial Sequence; identical to SEQ ID NO: 63677
  derived and/or modified sequence opt1 from hemagglutinin__InfluenzaA__ADM32078

SEQ ID NO: 66742 - RNA, 1701 nt, Artificial Sequence; identical to SEQ ID NO: 65265
  derived and/or modified sequence opt1 from hemagglutinin__InfluenzaA__ADM32088

SEQ ID NO: 66743 - RNA, 1701 nt, Artificial Sequence
  derived and/or modified sequence opt1 from hemagglutinin__InfluenzaA__ADM32098
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66744 - RNA, 1701 nt, Artificial Sequence; identical to SEQ ID NO: 63677
  derived and/or modified sequence opt1 from hemagglutinin__InfluenzaA__ADM32108

SEQ ID NO: 66745 - RNA, 1701 nt, Artificial Sequence; identical to SEQ ID NO: 65449
  derived and/or modified sequence opt1 from hemagglutinin__InfluenzaA__ADM32551

SEQ ID NO: 66746 - RNA, 1701 nt, Artificial Sequence; identical to SEQ ID NO: 63857
  derived and/or modified sequence opt1 from hemagglutinin__InfluenzaA__ADM32561

SEQ ID NO: 66747 - RNA, 1701 nt, Artificial Sequence; identical to SEQ ID NO: 63857
  derived and/or modified sequence opt1 from hemagglutinin__InfluenzaA__ADM32571

SEQ ID NO: 66748 - RNA, 1701 nt, Artificial Sequence; identical to SEQ ID NO: 63677
  derived and/or modified sequence opt1 from hemagglutinin__InfluenzaA__ADM32581

SEQ ID NO: 66749 - RNA, 1701 nt, Artificial Sequence; identical to SEQ ID NO: 65449
  derived and/or modified sequence opt1 from hemagglutinin__InfluenzaA__ADM32591

SEQ ID NO: 66750 - RNA, 1701 nt, Artificial Sequence; identical to SEQ ID NO: 63677
  derived and/or modified sequence opt1 from hemagglutinin__InfluenzaA__ADM32601

SEQ ID NO: 66751 - RNA, 1701 nt, Artificial Sequence; identical to SEQ ID NO: 63677
  derived and/or modified sequence opt1 from hemagglutinin__InfluenzaA__ADM32611

SEQ ID NO: 66752 - RNA, 1701 nt, Artificial Sequence; identical to SEQ ID NO: 64841
  derived and/or modified sequence opt1 from hemagglutinin__InfluenzaA__ADM32621

SEQ ID NO: 66753 - RNA, 1701 nt, Artificial Sequence
  derived and/or modified sequence opt1 from hemagglutinin__InfluenzaA__ADM32631
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcucaagggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgcgagcagcucagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcuggugaagaaggggaaccucuaccccaagcugagcaaguccuacaucaacgacaagggcaaggaggugcugguccucugggggauccaccaccccagcaccagcgccgaccagcagucccuguaccagaacgccgacgccuacguguucgugggcagcuccaaguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacaacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66754 - RNA, 1701 nt, Artificial Sequence; identical to SEQ ID NO: 64841
  derived and/or modified sequence opt1 from hemagglutinin__InfluenzaA__ADM32641

SEQ ID NO: 66755 - RNA, 1701 nt, Artificial Sequence; identical to SEQ ID NO: 63677
  derived and/or modified sequence opt1 from hemagglutinin__InfluenzaA__ADM32651

SEQ ID NO: 66756 - RNA, 1701 nt, Artificial Sequence
  derived and/or modified sequence opt1 from hemagglutinin__InfluenzaA__ADM32661
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaacgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66757 - RNA, 1701 nt, Artificial Sequence; identical to SEQ ID NO: 65265
  derived and/or modified sequence opt1 from hemagglutinin__InfluenzaA__ADM32671

SEQ ID NO: 66758 - RNA, 1701 nt, Artificial Sequence; identical to SEQ ID NO: 63677
  derived and/or modified sequence opt1 from hemagglutinin__InfluenzaA__ADM32681

SEQ ID NO: 66759 - RNA, 1701 nt, Artificial Sequence; identical to SEQ ID NO: 63857
  derived and/or modified sequence opt1 from hemagglutinin__InfluenzaA__ADM32691

SEQ ID NO: 66760 - RNA, 1701 nt, Artificial Sequence; identical to SEQ ID NO: 63677
  derived and/or modified sequence opt1 from hemagglutinin__InfluenzaA__ADM32701

SEQ ID NO: 66761 - RNA, 1701 nt, Artificial Sequence; identical to SEQ ID NO: 63857
  derived and/or modified sequence opt1 from hemagglutinin__InfluenzaA__ADM32711

SEQ ID NO: 66762 - RNA, 1701 nt, Artificial Sequence; identical to SEQ ID NO: 63857
  derived and/or modified sequence opt1 from hemagglutinin__InfluenzaA__ADM32721

SEQ ID NO: 66763 - RNA, 1701 nt, Artificial Sequence; identical to SEQ ID NO: 63857
  derived and/or modified sequence opt1 from hemagglutinin__InfluenzaA__ADM32741

SEQ ID NO: 66764 - RNA, 1701 nt, Artificial Sequence; identical to SEQ ID NO: 63857
  derived and/or modified sequence opt1 from hemagglutinin__InfluenzaA__ADM32751

SEQ ID NO: 66765 - RNA, 1701 nt, Artificial Sequence; identical to SEQ ID NO: 65265
  derived and/or modified sequence opt1 from hemagglutinin__InfluenzaA__ADM32761

SEQ ID NO: 66766 - RNA, 1701 nt, Artificial Sequence
  derived and/or modified sequence opt1 from hemagglutinin__InfluenzaA__ADM32771
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccgagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagcaaggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66767 - RNA, 1701 nt, Artificial Sequence
  derived and/or modified sequence opt1 from hemagglutinin__InfluenzaA__ADM32781
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccuccuuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 66768 - RNA, 1701 nt, Artificial Sequence; identical to SEQ ID NO: 63857
  derived and/or modified sequence opt1 from hemagglutinin__InfluenzaA__ADM32791

SEQ ID NO: 66769 - RNA, 1701 nt, Artificial Sequence
  derived and/or modified sequence opt1 from hemagglutinin__InfluenzaA__ADM32801
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggagaacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 66770 - RNA, 1701 nt, Artificial Sequence
  derived and/or modified sequence opt1 from hemagglutinin__InfluenzaA__ADM32811
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66771 - RNA, 1701 nt, Artificial Sequence; identical to SEQ ID NO: 63677
  derived and/or modified sequence opt1 from hemagglutinin__InfluenzaA__ADM32821

SEQ ID NO: 66772 - RNA, 1701 nt, Artificial Sequence; identical to SEQ ID NO: 65265
  derived and/or modified sequence opt1 from hemagglutinin__InfluenzaA__ADM32831

SEQ ID NO: 66773 - RNA, 1701 nt, Artificial Sequence; identical to SEQ ID NO: 63857
  derived and/or modified sequence opt1 from hemagglutinin__InfluenzaA__ADM32841

SEQ ID NO: 66774 - RNA, 1701 nt, Artificial Sequence; identical to SEQ ID NO: 65265
  derived and/or modified sequence opt1 from hemagglutinin__InfluenzaA__ADM32851

SEQ ID NO: 66775 - RNA, 1701 nt, Artificial Sequence; identical to SEQ ID NO: 63857
  derived and/or modified sequence opt1 from hemagglutinin__InfluenzaA__ADM32861

SEQ ID NO: 66776 - RNA, 1701 nt, Artificial Sequence; identical to SEQ ID NO: 64841
  derived and/or modified sequence opt1 from hemagglutinin__InfluenzaA__ADM32871

SEQ ID NO: 66777 - RNA, 1701 nt, Artificial Sequence; identical to SEQ ID NO: 65844
  derived and/or modified sequence opt1 from hemagglutinin__InfluenzaA__ADM32881

SEQ ID NO: 66778 - RNA, 1701 nt, Artificial Sequence
  derived and/or modified sequence opt1 from hemagglutinin__InfluenzaA__ADM32929
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcggugccgcaucugcaucuga

SEQ ID NO: 66779 - RNA, 1701 nt, Artificial Sequence
  derived and/or modified sequence opt1 from hemagglutinin__InfluenzaA__ADM32939
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcggugccgcaucugcaucuga

SEQ ID NO: 66780 - RNA, 1701 nt, Artificial Sequence
  derived and/or modified sequence opt1 from hemagglutinin__InfluenzaA__ADM32949
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcggugccgcaucugcaucuga

SEQ ID NO: 66781 - RNA, 1701 nt, Artificial Sequence
  derived and/or modified sequence opt1 from hemagglutinin__InfluenzaA__ADM32958
augaaggccauccugguguuccuccuguacaccuucgccaccgcgaacgccgacacgcugugcaucggcuaccacgccaacaacagcaccgacaccgucgacaccgugcucgagaagaacgugacggucacccacuccgugaacauccuggaggacaagcacaacgggaagcugugcaagcuccgcggcguggcgccccugcaccuggggaagugcaacaucgccggcuggauccucgggaacccggagugcgagagccuguccaccgccagcuccuggagcuacaucgucgagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcuggucaagaaggggaacagcuaccccaagcucuccaagagcuacaucaacgacaagggcaaggaggugcuggugcugugggggauccaccaccccagcaccuccgccgaccagcagagccucuaccagaacgccgacgccuacgucuucguggaguccagccgguacuccaagaaguucaagcccgagaucgccauccgcccgaaggugcgggaccaggagggccgcaugaacuacuacuggacgcuggucgagcccggcgacaagaucaccuucgaggcgaccgggaaccugguggugccccgguacgccuucgccauggagcgcaacgccggcagcgggaucaucaucuccgacacccccguccacgacugcaacacgaccugccagaccccgaagggcgccaucaacaccagccuccccuuccagaacauccaccccaucacgaucggcaagugccccaaguacgugaaguccaccaagcugcggcuggcgaccgggcuccgcaacgugccgagcauccagucccggggccuguucggggccaucgccggcuucaucgagggcggguggaccggcauggucgacgggugguacggcuaccaccaccagaacgagcaggggagcggcuacgccgccgaccugaaguccacgcagaacgcgaucgacgagaucaccaacaaggugaacagcgugaucgagaagaugaacacccaguucaccgccgucgggaaggaguucaaccaccucgagaagcgccuggagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggaggucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgccgccagcucccugguccucguggugagccugggcgccaucuccuucuggaugugcagcaacgggucccugcggugccgcaucugcaucuga

SEQ ID NO: 66782 - RNA, 1701 nt, Artificial Sequence
  derived and/or modified sequence opt1 from hemagglutinin__InfluenzaA__ADM32977
augaaggccauccuggugguccuccugugcaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacggcaucaccaacaagaucaacuccgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgcgaggagaucgacggggugaagcucgagagcacccggaucuaccagauccuggcgaucuacuccaccguggccagcagccugguccucguggugucccugggcgccaucagcuucuggaugugcuccaacggcagccugcgcugccggaucugcaucuga

SEQ ID NO: 66783 - RNA, 1701 nt, Artificial Sequence
  derived and/or modified sequence opt1 from hemagglutinin__InfluenzaA__ADM32986
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccaacagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcaaguacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacggcaucaccaacaagaucaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccugaacuaccacgacuccaacgugaagaaccucuacgagaaggugcggagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacagcaccguggccuccagccugguccucguggugagccugggcgccaucuccuucuggaugugcagcaacggcucccugcgcugccggaucugcaucuga

SEQ ID NO: 66784 - RNA, 1701 nt, Artificial Sequence
  derived and/or modified sequence opt1 from hemagglutinin__InfluenzaA__ADM32995
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccaacagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcaaguacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacggcaucaccaacaagaucaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggcgaucuacagcaccguggccuccagccugguccucguggugagccugggcgccaucuccuucuggaugugcagcaacggcucccugcgcugccggaucugcaucuga

SEQ ID NO: 66785 - RNA, 1701 nt, Artificial Sequence; identical to SEQ ID NO: 64778
  derived and/or modified sequence opt1 from hemagglutinin__InfluenzaA__ADM33004

SEQ ID NO: 66786 - RNA, 1701 nt, Artificial Sequence; identical to SEQ ID NO: 63677
  derived and/or modified sequence opt1 from hemagglutinin__InfluenzaA__ADM33023

SEQ ID NO: 66787 - RNA, 1701 nt, Artificial Sequence
  derived and/or modified sequence opt1 from hemagglutinin__InfluenzaA__ADM33040
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcggugccgcaucugcaucuga

SEQ ID NO: 66788 - RNA, 1701 nt, Artificial Sequence
  derived and/or modified sequence opt1 from hemagglutinin__InfluenzaA__ADM33050
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgugccgagcauccagucccggggccucuucggggccaucgccggguucaucgagggcggcuggacggggauggucgacggcugguacggguaccaccaccagaacgagcagggcagcggguacgccgccgaccugaaguccacccagaacgcgaucgacgagaucaccaacaaggugaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacagcaccguggccuccagccucguccugguggugagccugggggccaucuccuucuggaugugcagcaacggcucccuccggugccgcaucugcaucuga

SEQ ID NO: 66789 - RNA, 1701 nt, Artificial Sequence
  derived and/or modified sequence opt1 from hemagglutinin__InfluenzaA__ADM33069
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcggugccgcaucugcaucuga

SEQ ID NO: 66790 - RNA, 1701 nt, Artificial Sequence
  derived and/or modified sequence opt1 from hemagglutinin__InfluenzaA__ADM33079
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcggugccgcaucugcaucuga

SEQ ID NO: 66791 - RNA, 1701 nt, Artificial Sequence
  derived and/or modified sequence opt1 from hemagglutinin__InfluenzaA__ADM33099
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucauggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcggugccgcaucugcaucuga

SEQ ID NO: 66792 - RNA, 1701 nt, Artificial Sequence; identical to SEQ ID NO: 66791
  derived and/or modified sequence opt1 from hemagglutinin__InfluenzaA__ADM33109

SEQ ID NO: 66793 - RNA, 1701 nt, Artificial Sequence
  derived and/or modified sequence opt1 from hemagglutinin__InfluenzaA__ADM33128
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcggugccgcaucugcaucuga

SEQ ID NO: 66794 - RNA, 1701 nt, Artificial Sequence; identical to SEQ ID NO: 66793
  derived and/or modified sequence opt1 from hemagglutinin__InfluenzaA__ADM33137

SEQ ID NO: 66795 - RNA, 1701 nt, Artificial Sequence; identical to SEQ ID NO: 66793
  derived and/or modified sequence opt1 from hemagglutinin__InfluenzaA__ADM33147

SEQ ID NO: 66796 - RNA, 1701 nt, Artificial Sequence; identical to SEQ ID NO: 66793
  derived and/or modified sequence opt1 from hemagglutinin__InfluenzaA__ADM33157

SEQ ID NO: 66797 - RNA, 1701 nt, Artificial Sequence
  derived and/or modified sequence opt1 from hemagglutinin__InfluenzaA__ADM33167
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagagcacccgcaucuaccagauccucgcgaucuacuccaccgucgccagcagccuggugcugguggucucccucggggccaucagcuucuggaugugcuccaacggcagccugcggugccgcaucugcaucuga

SEQ ID NO: 66798 - RNA, 1701 nt, Artificial Sequence; identical to SEQ ID NO: 65864
  derived and/or modified sequence opt1 from hemagglutinin__InfluenzaA__ADM33177

SEQ ID NO: 66799 - RNA, 1701 nt, Artificial Sequence; identical to SEQ ID NO: 66793
  derived and/or modified sequence opt1 from hemagglutinin__InfluenzaA__ADM33186

SEQ ID NO: 66800 - RNA, 1701 nt, Artificial Sequence; identical to SEQ ID NO: 66793
  derived and/or modified sequence opt1 from hemagglutinin__InfluenzaA__ADM33195

SEQ ID NO: 66801 - RNA, 1701 nt, Artificial Sequence; identical to SEQ ID NO: 66790
  derived and/or modified sequence opt1 from hemagglutinin__InfluenzaA__ADM33204

SEQ ID NO: 66802 - RNA, 1701 nt, Artificial Sequence
  derived and/or modified sequence opt1 from hemagglutinin__InfluenzaA__ADM33222
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcggugccgcaucugcaucuga

SEQ ID NO: 66803 - RNA, 1701 nt, Artificial Sequence
  derived and/or modified sequence opt1 from hemagglutinin__InfluenzaA__ADM33232
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaccaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66804 - RNA, 1701 nt, Artificial Sequence
  derived and/or modified sequence opt1 from hemagglutinin__InfluenzaA__ADM33241
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggagaacagcuaccccaagcucuccaagagcuacaucaacgacaaggggaaggaggugcugguccuguggggcauccaccaccccagcaccuccgccgaccagcagagccucuaccagaacgccgacgccuacguguucgugggguccagccgguacuccaagaaguucaagcccgagaucacgauccgcccgaagguccgggaccaggagggccgcaugaacuacuacuggacccugguggagcccggcgacaagaucaccuucgaggccaccgggaaccugguggucccccgguacgcguucgccauggagcgcaacgccggcagcgggaucaucaucuccgacacgcccgugcacgacugcaacacgaccugccagaccccgaagggcgccaucaacaccagccuccccuuccagaacauccaccccaucaccaucggcaagugccccaaguacgugaaguccaccaagcugcggcuggccaccgggcuccgcaacgucccgagcauccagucccggggccuguucggggcgaucgccggcuucaucgagggcggguggacgggcaugguggacgggugguacggcuaccaccaccagaacgagcaggggagcggcuacgccgccgaccugaaguccacccagaacgccaucgacgagaucaccaacaaggugaacagcgucaucgagaagaugaacacccaguucacggcgguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcgagcucccuggugcugguggucagccucggcgccaucuccuucuggaugugcagcaacgggucccugcggugccgcaucugcaucuga

SEQ ID NO: 66805 - RNA, 1701 nt, Artificial Sequence; identical to SEQ ID NO: 66802
  derived and/or modified sequence opt1 from hemagglutinin__InfluenzaA__ADM33251

SEQ ID NO: 66806 - RNA, 1701 nt, Artificial Sequence
  derived and/or modified sequence opt1 from hemagglutinin__InfluenzaA__ADM33260
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaagggggacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacaccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcaacggcucccugcggugccgcaucugcaucuga

SEQ ID NO: 66807 - RNA, 1701 nt, Artificial Sequence
  derived and/or modified sequence opt1 from hemagglutinin__InfluenzaA__ADM33280
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgugagcuccuggagcuacaucguggagaccuccagcuccgacaacggcacgugcuaccccggcgacuucaucgacuacgaggagcugcgggagcagcucagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcuggugaagaaggggaacagcuaccccaagcucuccaagagcuacaucaacgacaagggcaaggagguccuggugcugugggggauccaccaccccagcaccuccgcggaccagcagagccucuaccagaacgccgacgccuacguguucgucggcuccagccgguacuccaagaaguucaagcccgagaucgccauccgcccgaaggugcgggaccaggagggccgcaugaacuacuacuggacgcugguggagcccggggacaagaucaccuucgaggccaccggcaaccuggucgugccccgguacgcguucgccauggagcgcaacgccgggagcggcaucaucaucuccgacacccccgugcacgacugcaacacgaccugccagaccccgcggggcgccaucaacaccagccuccccuuccagaacauccaccccaucacgaucgggaagugccccaaguacgucaaguccaccaagcugcgccuggccaccggccuccggaacgugccgagcauccagucccgcgggcuguucggcgcgaucgccggguucaucgagggcggcuggaccgggaugguggacggcugguacggguaccaccaccagaacgagcagggcagcggguacgccgccgaccugaaguccacgcagaacgccaucgacgagaucaccaacaaggucaacagcgugaucgagaagaugaacacccaguucaccgcggucggcaaggaguucaaccaccucgagaagcggaucgagaaccugaacaagaagguggacgacggcuuccuggacaucuggacguacaacgccgagcuccuggugcugcucgagaacgagcgcacccuggacuaccacgacuccaacgucaagaaccuguacgagaaggugcggagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgucaagcuggaguccacccggaucuaccagauccucgccaucuacagcaccguggcgagcucccuggugcuggucgugagccucggggccaucuccuucuggaugugcagcaacggcucccugcagugccgcaucugcaucuga

SEQ ID NO: 66808 - RNA, 1701 nt, Artificial Sequence; identical to SEQ ID NO: 64124
  derived and/or modified sequence opt1 from hemagglutinin__InfluenzaA__ADM33290

SEQ ID NO: 66809 - RNA, 1701 nt, Artificial Sequence; identical to SEQ ID NO: 63677
  derived and/or modified sequence opt1 from hemagglutinin__InfluenzaA__ADM33300

SEQ ID NO: 66810 - RNA, 1701 nt, Artificial Sequence; identical to SEQ ID NO: 63664
  derived and/or modified sequence opt1 from hemagglutinin__InfluenzaA__ADM33310

SEQ ID NO: 66811 - RNA, 1701 nt, Artificial Sequence
  derived and/or modified sequence opt1 from hemagglutinin__InfluenzaA__ADM33320
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgcgagcuccuggagcuacaucguggagaccuucuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucagcaaguccuacaucaacgacaagggcaaggaggugcugguccugugggggauccaccaccccagcaccagcgccgaccagcagucccucuaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucagcgacacccccgugcacgacugcaacacgaccugccagaccccgaagggcgccaucaacaccucccuccccuuccagaacauccaccccaucacgaucgggaagugccccaaguacgucaagagcaccaagcugcggcuggcgaccggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 66812 - RNA, 1701 nt, Artificial Sequence; identical to SEQ ID NO: 63703
  derived and/or modified sequence opt1 from hemagglutinin__InfluenzaA__ADM33340

SEQ ID NO: 66813 - RNA, 1701 nt, Artificial Sequence
  derived and/or modified sequence opt1 from hemagglutinin__InfluenzaA__ADM33355
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacaacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 66814 - RNA, 1701 nt, Artificial Sequence; identical to SEQ ID NO: 66813
  derived and/or modified sequence opt1 from hemagglutinin__InfluenzaA__ADM33365

SEQ ID NO: 66815 - RNA, 1701 nt, Artificial Sequence; identical to SEQ ID NO: 63703
  derived and/or modified sequence opt1 from hemagglutinin__InfluenzaA__ADM33375

SEQ ID NO: 66816 - RNA, 1701 nt, Artificial Sequence
  derived and/or modified sequence opt1 from hemagglutinin__InfluenzaA__ADM33385
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccagcaagggcgccaucaacaccucccucccguuccagaacauccaccccaucacgaucgggaagugccccaaguacgucaagagcaccaagcugcggcuggcgaccggccuccgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcuggagagcacccgcaucuaccagauccucgcgaucuacagcaccgucgccuccagccuggugcugguggucucccucggggccaucagcuucuggaugugcuccaacggcagccugcagugccggaucugcaucuga

SEQ ID NO: 66817 - RNA, 1701 nt, Artificial Sequence; identical to SEQ ID NO: 64124
  derived and/or modified sequence opt1 from hemagglutinin__InfluenzaA__ADM33395

SEQ ID NO: 66818 - RNA, 1701 nt, Artificial Sequence; identical to SEQ ID NO: 64124
  derived and/or modified sequence opt1 from hemagglutinin__InfluenzaA__ADM33405

SEQ ID NO: 66819 - RNA, 1701 nt, Artificial Sequence; identical to SEQ ID NO: 66813
  derived and/or modified sequence opt1 from hemagglutinin__InfluenzaA__ADM33415

SEQ ID NO: 66820 - RNA, 1701 nt, Artificial Sequence; identical to SEQ ID NO: 64520
  derived and/or modified sequence opt1 from hemagglutinin__InfluenzaA__ADM33425

SEQ ID NO: 66821 - RNA, 1701 nt, Artificial Sequence
  derived and/or modified sequence opt1 from hemagglutinin__InfluenzaA__ADM34007
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccuggaggagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66822 - RNA, 1701 nt, Artificial Sequence; identical to SEQ ID NO: 63677
  derived and/or modified sequence opt1 from hemagglutinin__InfluenzaA__ADM52443

SEQ ID NO: 66823 - RNA, 1701 nt, Artificial Sequence
  derived and/or modified sequence opt1 from hemagglutinin__InfluenzaA__ADM52453
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccauccacgacugcaacacgaccugccagaccccgaagggcgccaucaacaccagccuccccuuccagaacgugcaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 66824 - RNA, 1701 nt, Artificial Sequence
  derived and/or modified sequence opt1 from hemagglutinin__InfluenzaA__ADM52473
augaaggccauccuggccgugcuccuguacaccuucgcgaccgccaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgugaccgccgccugcccgcacgcgggggccaaguccuucuacaagaaccugcucuggcuggucaagaagggcaacagcuaccccaagcuguccaagagcuacaucaacgacaaggggaaggaggugcucgugcuguggggcauccaccaccccagcaccuccgccgaccagcagagccuguaccagaacgccgacgccuacgucuucgugggcacgucccgguacagcaagaaguucaagcccgagaucgcgauccgcccgaaggugcgggaccaggaggggcgcaugaacuacuacuggacccucgucggccccggggacaagaucaccuucgaggccaccggcaaccugguggugccccgguacgccuucgccauggagcgcaacgccggcuccgggaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcuccggcuggccaccggccugcgcaacgugccguccauccagagccgggggcuguucggcgccaucgccggcuucaucgagggcggguggacggggaugguggacggcugguacggguaccaccaccagaacgagcagggcuccggcuacgccgcggaccucaagagcacccagaacgccaucgacgagaucaccaacaaggugaacuccgugaucgagaagaugaacacccaguucacggccgucgggaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcucaaccgggaggagaucgacggcgugaagcuggagagcacccgcaucuaccagauccuggccaucuacuccaccguggccagcagccucguccugguggugucccugggcgccaucagcuucuggaugugcuccaacgggagccuccagugccggaucugcaucuga

SEQ ID NO: 66825 - RNA, 1701 nt, Artificial Sequence; identical to SEQ ID NO: 64841
  derived and/or modified sequence opt1 from hemagglutinin__InfluenzaA__ADM52483

SEQ ID NO: 66826 - RNA, 1701 nt, Artificial Sequence; identical to SEQ ID NO: 63857
  derived and/or modified sequence opt1 from hemagglutinin__InfluenzaA__ADM52493

SEQ ID NO: 66827 - RNA, 1701 nt, Artificial Sequence; identical to SEQ ID NO: 63857
  derived and/or modified sequence opt1 from hemagglutinin__InfluenzaA__ADM52513

SEQ ID NO: 66828 - RNA, 1701 nt, Artificial Sequence; identical to SEQ ID NO: 63857
  derived and/or modified sequence opt1 from hemagglutinin__InfluenzaA__ADM52524

SEQ ID NO: 66829 - RNA, 1701 nt, Artificial Sequence; identical to SEQ ID NO: 63857
  derived and/or modified sequence opt1 from hemagglutinin__InfluenzaA__ADM52534

SEQ ID NO: 66830 - RNA, 1701 nt, Artificial Sequence; identical to SEQ ID NO: 63857
  derived and/or modified sequence opt1 from hemagglutinin__InfluenzaA__ADM52554

SEQ ID NO: 66831 - RNA, 1701 nt, Artificial Sequence; identical to SEQ ID NO: 63857
  derived and/or modified sequence opt1 from hemagglutinin__InfluenzaA__ADM52564

SEQ ID NO: 66832 - RNA, 1701 nt, Artificial Sequence; identical to SEQ ID NO: 63664
  derived and/or modified sequence opt1 from hemagglutinin__InfluenzaA__ADM52574

SEQ ID NO: 66833 - RNA, 1701 nt, Artificial Sequence; identical to SEQ ID NO: 63677
  derived and/or modified sequence opt1 from hemagglutinin__InfluenzaA__ADM52584

SEQ ID NO: 66834 - RNA, 1701 nt, Artificial Sequence
  derived and/or modified sequence opt1 from hemagglutinin__InfluenzaA__ADM52594
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66835 - RNA, 1701 nt, Artificial Sequence; identical to SEQ ID NO: 63857
  derived and/or modified sequence opt1 from hemagglutinin__InfluenzaA__ADM52604

SEQ ID NO: 66836 - RNA, 1701 nt, Artificial Sequence; identical to SEQ ID NO: 63857
  derived and/or modified sequence opt1 from hemagglutinin__InfluenzaA__ADM52614

SEQ ID NO: 66837 - RNA, 1701 nt, Artificial Sequence; identical to SEQ ID NO: 65449
  derived and/or modified sequence opt1 from hemagglutinin__InfluenzaA__ADM52624

SEQ ID NO: 66838 - RNA, 1701 nt, Artificial Sequence; identical to SEQ ID NO: 63857
  derived and/or modified sequence opt1 from hemagglutinin__InfluenzaA__ADM52634

SEQ ID NO: 66839 - RNA, 1701 nt, Artificial Sequence; identical to SEQ ID NO: 63857
  derived and/or modified sequence opt1 from hemagglutinin__InfluenzaA__ADM52644

SEQ ID NO: 66840 - RNA, 1701 nt, Artificial Sequence; identical to SEQ ID NO: 63857
  derived and/or modified sequence opt1 from hemagglutinin__InfluenzaA__ADM52654

SEQ ID NO: 66841 - RNA, 1701 nt, Artificial Sequence; identical to SEQ ID NO: 65265
  derived and/or modified sequence opt1 from hemagglutinin__InfluenzaA__ADM52664

SEQ ID NO: 66842 - RNA, 1701 nt, Artificial Sequence; identical to SEQ ID NO: 65449
  derived and/or modified sequence opt1 from hemagglutinin__InfluenzaA__ADM52674

SEQ ID NO: 66843 - RNA, 1701 nt, Artificial Sequence; identical to SEQ ID NO: 63857
  derived and/or modified sequence opt1 from hemagglutinin__InfluenzaA__ADM52684

SEQ ID NO: 66844 - RNA, 1701 nt, Artificial Sequence; identical to SEQ ID NO: 65449
  derived and/or modified sequence opt1 from hemagglutinin__InfluenzaA__ADM52704

SEQ ID NO: 66845 - RNA, 1701 nt, Artificial Sequence; identical to SEQ ID NO: 65265
  derived and/or modified sequence opt1 from hemagglutinin__InfluenzaA__ADM52714

SEQ ID NO: 66846 - RNA, 1701 nt, Artificial Sequence
  derived and/or modified sequence opt1 from hemagglutinin__InfluenzaA__ADM86399
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccgugaacaccagccuccccuuccagaacauccaccccaucacgaucgggaagugccccaaguacgucaaguccaccaagcugcggcuggcgaccggccuccgcaacgugccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggucaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcagccagcucaagaacaacgccaaggagguggggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgcgaucuacagcaccgccgccagcucccuggugcuggucgugagccucggggccaucuccuucuggaugugcagcaacggcucccugcagugccggaucugcaucuga

SEQ ID NO: 66847 - RNA, 1701 nt, Artificial Sequence; identical to SEQ ID NO: 63677
  derived and/or modified sequence opt1 from hemagglutinin__InfluenzaA__ADM86409

SEQ ID NO: 66848 - RNA, 1701 nt, Artificial Sequence; identical to SEQ ID NO: 63677
  derived and/or modified sequence opt1 from hemagglutinin__InfluenzaA__ADM86419

SEQ ID NO: 66849 - RNA, 1701 nt, Artificial Sequence; identical to SEQ ID NO: 65326
  derived and/or modified sequence opt1 from hemagglutinin__InfluenzaA__ADM86440

SEQ ID NO: 66850 - RNA, 1701 nt, Artificial Sequence; identical to SEQ ID NO: 63677
  derived and/or modified sequence opt1 from hemagglutinin__InfluenzaA__ADM86450

SEQ ID NO: 66851 - RNA, 1707 nt, Artificial Sequence
  derived and/or modified sequence opt1 from hemagglutinin__InfluenzaA__ADM95450
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggcccagccacgaggccucccugggcgugagcgccgcgugccccuaccagggcaaguccagcuucuuccgcaacguggucuggcugaucaagaagaacaacaccuaccccacgaucaagcgguccuacaacaacaccaaccaggaggaccuccuggugaugugggggauccaccacccgaacgacgccgccgagcagaccaaccuguaccagaaccccaccacguacaucagcgugggcaccuccacccucaaccagcgccugaccccgcggaucgccacgcgcagcaaggucaacgggcaguccggccggauggaguucuucuggaccauccugaagcccaacgacgcgaucaacuucgagagcaacgggaacuucaucgccccggaguacgccuacaagaucgugaagaagggcgacuccaccaucaugaaguccgagcucgaguacggcaacugcaacaccaagugccagacgcccaugggggccaucaacagcuccaugcccuuccacaacauccacccccugaccaucggcgagugcccgaaguacgucaagagcaaccgccuggugcucgccaccgggcugcggaacagcccccagcgcgagggccggcgcaagaagcggggccuguucggggcgaucgccggcuucaucgagggcggguggcaggggaugguggacggcugguacggcuaccaccacagcaacgagcagggguccggcuacgccgccgacaaggagagcacccagaaggccaucgacggggugacgaacaaggucaacuccaucaucgacaagaugaacacccaguucgaggcggugggccgcgaguucaacaaccucgagcggcgcaucgagaaccugaacaagaagauggaggacggguuccuggacguguggaccuacaacgccgagcuccugguccugauggagaacgagcggacccucgacuuccacgacagcaacgugaagaaccuguacgacaagguccgccugcagcuccgggacaacgccaaggagcugggcaacggcugcuucgaguucuaccacaagugcgacaacgagugcauggaguccgugcgcaacgggacguacgacuacccccaguacagcgaggaggcccggcugaagcgcgaggagaucuccggcgugaagcucgagagcaucgggaucuaccagauccuguccaucuacagcaccgucgccuccagccuggcgcucgccaucaugguggccggccugucccuguggaugugcagcaacgggucccuccagugccgcaucugcaucuga

SEQ ID NO: 66852 - RNA, 1701 nt, Artificial Sequence; identical to SEQ ID NO: 63677
  derived and/or modified sequence opt1 from hemagglutinin__InfluenzaA__ADM95745

SEQ ID NO: 66853 - RNA, 1701 nt, Artificial Sequence; identical to SEQ ID NO: 63677
  derived and/or modified sequence opt1 from hemagglutinin__InfluenzaA__ADM95746

SEQ ID NO: 66854 - RNA, 1701 nt, Artificial Sequence; identical to SEQ ID NO: 63677
  derived and/or modified sequence opt1 from hemagglutinin__InfluenzaA__ADM95747

SEQ ID NO: 66855 - RNA, 1701 nt, Artificial Sequence; identical to SEQ ID NO: 63677
  derived and/or modified sequence opt1 from hemagglutinin__InfluenzaA__ADM95749

SEQ ID NO: 66856 - RNA, 1701 nt, Artificial Sequence
  derived and/or modified sequence opt1 from hemagglutinin__InfluenzaA__ADM95750
augaaggccauccuggugguccuccuguacaccuucgccaccgcgaacgccgacacgcugugcaucggcuaccacgccaacaacagcaccgacaccguggacaccgugcucgagaagaacgucacggugacccacuccuucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggagcuccuaccccaagcugagcaagagcuacaucaacgacaagggcaaggaggugcuggugcucugggggauccaccaccccuccaccagcgccgaccagcagucccuguaccagaacgccgacgccuacgucuucgugggcagcucccgguacagcaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccggguccggcaucaucaucagcgacacccccguccacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacagcaccguggccuccagccugguccucguggugucccugggggccaucagcuucuggaugugcuccaacggcagccugcagugccggaucugcaucuga

SEQ ID NO: 66857 - RNA, 1701 nt, Artificial Sequence; identical to SEQ ID NO: 63677
  derived and/or modified sequence opt1 from hemagglutinin__InfluenzaA__ADM95751

SEQ ID NO: 66858 - RNA, 1701 nt, Artificial Sequence; identical to SEQ ID NO: 63677
  derived and/or modified sequence opt1 from hemagglutinin__InfluenzaA__ADM95752

SEQ ID NO: 66859 - RNA, 1701 nt, Artificial Sequence; identical to SEQ ID NO: 63677
  derived and/or modified sequence opt1 from hemagglutinin__InfluenzaA__ADM95753

SEQ ID NO: 66860 - RNA, 1701 nt, Artificial Sequence; identical to SEQ ID NO: 63677
  derived and/or modified sequence opt1 from hemagglutinin__InfluenzaA__ADM95754

SEQ ID NO: 66861 - RNA, 1701 nt, Artificial Sequence; identical to SEQ ID NO: 63677
  derived and/or modified sequence opt1 from hemagglutinin__InfluenzaA__ADM95755

SEQ ID NO: 66862 - RNA, 1701 nt, Artificial Sequence; identical to SEQ ID NO: 63857
  derived and/or modified sequence opt1 from hemagglutinin__InfluenzaA__ADM95757

SEQ ID NO: 66863 - RNA, 1701 nt, Artificial Sequence; identical to SEQ ID NO: 63677
  derived and/or modified sequence opt1 from hemagglutinin__InfluenzaA__ADM95758

SEQ ID NO: 66864 - RNA, 1701 nt, Artificial Sequence
  derived and/or modified sequence opt1 from hemagglutinin__InfluenzaA__ADM95759
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacuacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66865 - RNA, 1701 nt, Artificial Sequence; identical to SEQ ID NO: 63664
  derived and/or modified sequence opt1 from hemagglutinin__InfluenzaA__ADM95760

SEQ ID NO: 66866 - RNA, 1701 nt, Artificial Sequence; identical to SEQ ID NO: 63677
  derived and/or modified sequence opt1 from hemagglutinin__InfluenzaA__ADM95761

SEQ ID NO: 66867 - RNA, 1701 nt, Artificial Sequence
  derived and/or modified sequence opt1 from hemagglutinin__InfluenzaA__ADM95763
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagaacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 66868 - RNA, 1701 nt, Artificial Sequence; identical to SEQ ID NO: 63677
  derived and/or modified sequence opt1 from hemagglutinin__InfluenzaA__ADM95764

SEQ ID NO: 66869 - RNA, 1701 nt, Artificial Sequence; identical to SEQ ID NO: 63677
  derived and/or modified sequence opt1 from hemagglutinin__InfluenzaA__ADM95765

SEQ ID NO: 66870 - RNA, 1701 nt, Artificial Sequence; identical to SEQ ID NO: 63677
  derived and/or modified sequence opt1 from hemagglutinin__InfluenzaA__ADM95767

SEQ ID NO: 66871 - RNA, 1701 nt, Artificial Sequence; identical to SEQ ID NO: 64520
  derived and/or modified sequence opt1 from hemagglutinin__InfluenzaA__ADM95768

SEQ ID NO: 66872 - RNA, 1701 nt, Artificial Sequence; identical to SEQ ID NO: 64030
  derived and/or modified sequence opt1 from hemagglutinin__InfluenzaA__ADM95769

SEQ ID NO: 66873 - RNA, 1701 nt, Artificial Sequence; identical to SEQ ID NO: 65793
  derived and/or modified sequence opt1 from hemagglutinin__InfluenzaA__ADM95771

SEQ ID NO: 66874 - RNA, 1701 nt, Artificial Sequence; identical to SEQ ID NO: 63677
  derived and/or modified sequence opt1 from hemagglutinin__InfluenzaA__ADM95772

SEQ ID NO: 66875 - RNA, 1701 nt, Artificial Sequence; identical to SEQ ID NO: 63677
  derived and/or modified sequence opt1 from hemagglutinin__InfluenzaA__ADM95774

SEQ ID NO: 66876 - RNA, 1701 nt, Artificial Sequence; identical to SEQ ID NO: 63677
  derived and/or modified sequence opt1 from hemagglutinin__InfluenzaA__ADM95775

SEQ ID NO: 66877 - RNA, 1701 nt, Artificial Sequence; identical to SEQ ID NO: 64030
  derived and/or modified sequence opt1 from hemagglutinin__InfluenzaA__ADM95776

SEQ ID NO: 66878 - RNA, 1701 nt, Artificial Sequence; identical to SEQ ID NO: 64030
  derived and/or modified sequence opt1 from hemagglutinin__InfluenzaA__ADM95778

SEQ ID NO: 66879 - RNA, 1701 nt, Artificial Sequence
  derived and/or modified sequence opt1 from hemagglutinin__InfluenzaA__ADM95779
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagcccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 66880 - RNA, 1701 nt, Artificial Sequence; identical to SEQ ID NO: 64030
  derived and/or modified sequence opt1 from hemagglutinin__InfluenzaA__ADM95780

SEQ ID NO: 66881 - RNA, 1701 nt, Artificial Sequence; identical to SEQ ID NO: 64520
  derived and/or modified sequence opt1 from hemagglutinin__InfluenzaA__ADM95783

SEQ ID NO: 66882 - RNA, 1701 nt, Artificial Sequence; identical to SEQ ID NO: 63677
  derived and/or modified sequence opt1 from hemagglutinin__InfluenzaA__ADM95784

SEQ ID NO: 66883 - RNA, 1701 nt, Artificial Sequence; identical to SEQ ID NO: 63677
  derived and/or modified sequence opt1 from hemagglutinin__InfluenzaA__ADM95785

SEQ ID NO: 66884 - RNA, 1701 nt, Artificial Sequence
  derived and/or modified sequence opt1 from hemagglutinin__InfluenzaA__ADM95786
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgccccaagguccgggagcaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 66885 - RNA, 1701 nt, Artificial Sequence; identical to SEQ ID NO: 64030
  derived and/or modified sequence opt1 from hemagglutinin__InfluenzaA__ADM95788

SEQ ID NO: 66886 - RNA, 1701 nt, Artificial Sequence; identical to SEQ ID NO: 64030
  derived and/or modified sequence opt1 from hemagglutinin__InfluenzaA__ADM95789

SEQ ID NO: 66887 - RNA, 1701 nt, Artificial Sequence
  derived and/or modified sequence opt1 from hemagglutinin__InfluenzaA__ADM95790
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacaucccgagcauccagucccgcgggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgaggagaucgacggcgugaagcucgaguccacccggaucuaccagauccuggcgaucuacagcaccguggccuccagccugguccucguggugagccugggggccaucuccuucuggaugugcagcaacggcucccugcagugccgcaucugcaucuga

SEQ ID NO: 66888 - RNA, 1701 nt, Artificial Sequence; identical to SEQ ID NO: 66887
  derived and/or modified sequence opt1 from hemagglutinin__InfluenzaA__ADM95791

SEQ ID NO: 66889 - RNA, 1701 nt, Artificial Sequence; identical to SEQ ID NO: 66887
  derived and/or modified sequence opt1 from hemagglutinin__InfluenzaA__ADM95792

SEQ ID NO: 66890 - RNA, 1701 nt, Artificial Sequence; identical to SEQ ID NO: 66274
  derived and/or modified sequence opt1 from hemagglutinin__InfluenzaA__ADM95793

SEQ ID NO: 66891 - RNA, 1701 nt, Artificial Sequence; identical to SEQ ID NO: 64030
  derived and/or modified sequence opt1 from hemagglutinin__InfluenzaA__ADM95794

SEQ ID NO: 66892 - RNA, 1701 nt, Artificial Sequence; identical to SEQ ID NO: 63677
  derived and/or modified sequence opt1 from hemagglutinin__InfluenzaA__ADM95795

SEQ ID NO: 66893 - RNA, 1701 nt, Artificial Sequence; identical to SEQ ID NO: 64779
  derived and/or modified sequence opt1 from hemagglutinin__InfluenzaA__ADM95798

SEQ ID NO: 66894 - RNA, 1701 nt, Artificial Sequence
  derived and/or modified sequence opt1 from hemagglutinin__InfluenzaA__ADM95799
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgagaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 66895 - RNA, 1701 nt, Artificial Sequence
  derived and/or modified sequence opt1 from hemagglutinin__InfluenzaA__ADM95800
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggcgcccggggacaagaucaccuucgaggccaccggcaaccucguggucccccgguacgccuucgccauggagcgcaacgccggguccggcaucaucaucagcgacacgcccgugcacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 66896 - RNA, 1701 nt, Artificial Sequence; identical to SEQ ID NO: 64030
  derived and/or modified sequence opt1 from hemagglutinin__InfluenzaA__ADM95801

SEQ ID NO: 66897 - RNA, 1701 nt, Artificial Sequence; identical to SEQ ID NO: 64030
  derived and/or modified sequence opt1 from hemagglutinin__InfluenzaA__ADM95802

SEQ ID NO: 66898 - RNA, 1701 nt, Artificial Sequence; identical to SEQ ID NO: 66884
  derived and/or modified sequence opt1 from hemagglutinin__InfluenzaA__ADM95803

SEQ ID NO: 66899 - RNA, 1701 nt, Artificial Sequence
  derived and/or modified sequence opt1 from hemagglutinin__InfluenzaA__ADM95804
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagaacuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaagcucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 66900 - RNA, 1701 nt, Artificial Sequence; identical to SEQ ID NO: 65359
  derived and/or modified sequence opt1 from hemagglutinin__InfluenzaA__ADM95805

SEQ ID NO: 66901 - RNA, 1701 nt, Artificial Sequence; identical to SEQ ID NO: 64778
  derived and/or modified sequence opt1 from hemagglutinin__InfluenzaA__ADM95808

SEQ ID NO: 66902 - RNA, 1701 nt, Artificial Sequence; identical to SEQ ID NO: 64778
  derived and/or modified sequence opt1 from hemagglutinin__InfluenzaA__ADM95809

SEQ ID NO: 66903 - RNA, 1701 nt, Artificial Sequence; identical to SEQ ID NO: 64778
  derived and/or modified sequence opt1 from hemagglutinin__InfluenzaA__ADM95810

SEQ ID NO: 66904 - RNA, 1701 nt, Artificial Sequence
  derived and/or modified sequence opt1 from hemagglutinin__InfluenzaA__ADM95812
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccagcugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 66905 - RNA, 1701 nt, Artificial Sequence; identical to SEQ ID NO: 66274
  derived and/or modified sequence opt1 from hemagglutinin__InfluenzaA__ADM95816

SEQ ID NO: 66906 - RNA, 1701 nt, Artificial Sequence; identical to SEQ ID NO: 66274
  derived and/or modified sequence opt1 from hemagglutinin__InfluenzaA__ADM95819

SEQ ID NO: 66907 - RNA, 1701 nt, Artificial Sequence; identical to SEQ ID NO: 65359
  derived and/or modified sequence opt1 from hemagglutinin__InfluenzaA__ADM95820

SEQ ID NO: 66908 - RNA, 1701 nt, Artificial Sequence; identical to SEQ ID NO: 66274
  derived and/or modified sequence opt1 from hemagglutinin__InfluenzaA__ADM95821

SEQ ID NO: 66909 - RNA, 1701 nt, Artificial Sequence; identical to SEQ ID NO: 64778
  derived and/or modified sequence opt1 from hemagglutinin__InfluenzaA__ADM95822

SEQ ID NO: 66910 - RNA, 1701 nt, Artificial Sequence; identical to SEQ ID NO: 64778
  derived and/or modified sequence opt1 from hemagglutinin__InfluenzaA__ADM95823

SEQ ID NO: 66911 - RNA, 1701 nt, Artificial Sequence
  derived and/or modified sequence opt1 from hemagglutinin__InfluenzaA__ADM95824
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 66912 - RNA, 1701 nt, Artificial Sequence; identical to SEQ ID NO: 66274
  derived and/or modified sequence opt1 from hemagglutinin__InfluenzaA__ADM95825

SEQ ID NO: 66913 - RNA, 1701 nt, Artificial Sequence; identical to SEQ ID NO: 66274
  derived and/or modified sequence opt1 from hemagglutinin__InfluenzaA__ADM95826

SEQ ID NO: 66914 - RNA, 1701 nt, Artificial Sequence
  derived and/or modified sequence opt1 from hemagglutinin__InfluenzaA__ADM95827
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 66915 - RNA, 1701 nt, Artificial Sequence
  derived and/or modified sequence opt1 from hemagglutinin__InfluenzaA__ADM95828
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggauggccaccggccuccgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcuggagagcacccgcaucuaccagauccucgccaucuacuccaccguggccagcagccugguccugguggugucccucggggccaucagcuucuggaugugcuccaacggcagccugcagugccggaucugcaucuga

SEQ ID NO: 66916 - RNA, 1701 nt, Artificial Sequence
  derived and/or modified sequence opt1 from hemagglutinin__InfluenzaA__ADM95829
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggaggagaucgacggcgugaagcucgagagcacgcgcaucuaccagauccuggcgaucuacuccaccgucgccagcagccuggugcucguggucucccugggggccaucagcuucuggaugugcuccaacggcagccugcagugccggaucugcaucuga

SEQ ID NO: 66917 - RNA, 1701 nt, Artificial Sequence
  derived and/or modified sequence opt1 from hemagglutinin__InfluenzaA__ADM95831
augaaggccauccuggugguccuccuguacaccuucgugaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgccaccggccugcggaacgugccguccauccagagccgcgggcuguucggcgcgaucgccggguucaucgagggcggcuggacggggaugguggacggcugguacggguaccaccaccagaacgagcagggcuccggguacgccgccgaccucaagagcacccagcacgccaucgacgagaucaccaacaaggucaacuccgugaucgagaagaugaacacccaguucacggcggucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggccaucuacuccaccguggcgagcagccuggugcucgucgugucccugggggccaucagcuucuggaugugcuccaacggcagccugcagugccgcaucugcaucuga

SEQ ID NO: 66918 - RNA, 1701 nt, Artificial Sequence; identical to SEQ ID NO: 64778
  derived and/or modified sequence opt1 from hemagglutinin__InfluenzaA__ADM95832

SEQ ID NO: 66919 - RNA, 1701 nt, Artificial Sequence; identical to SEQ ID NO: 65359
  derived and/or modified sequence opt1 from hemagglutinin__InfluenzaA__ADM95833

SEQ ID NO: 66920 - RNA, 1701 nt, Artificial Sequence; identical to SEQ ID NO: 66904
  derived and/or modified sequence opt1 from hemagglutinin__InfluenzaA__ADM95834

SEQ ID NO: 66921 - RNA, 1701 nt, Artificial Sequence; identical to SEQ ID NO: 65359
  derived and/or modified sequence opt1 from hemagglutinin__InfluenzaA__ADM95836

SEQ ID NO: 66922 - RNA, 1701 nt, Artificial Sequence; identical to SEQ ID NO: 66274
  derived and/or modified sequence opt1 from hemagglutinin__InfluenzaA__ADM95837

SEQ ID NO: 66923 - RNA, 1701 nt, Artificial Sequence
  derived and/or modified sequence opt1 from hemagglutinin__InfluenzaA__ADM95838
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacagcuacccgaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 66924 - RNA, 1701 nt, Artificial Sequence; identical to SEQ ID NO: 65359
  derived and/or modified sequence opt1 from hemagglutinin__InfluenzaA__ADM95839

SEQ ID NO: 66925 - RNA, 1701 nt, Artificial Sequence; identical to SEQ ID NO: 66884
  derived and/or modified sequence opt1 from hemagglutinin__InfluenzaA__ADM95840

SEQ ID NO: 66926 - RNA, 1701 nt, Artificial Sequence; identical to SEQ ID NO: 66884
  derived and/or modified sequence opt1 from hemagglutinin__InfluenzaA__ADM95842

SEQ ID NO: 66927 - RNA, 1701 nt, Artificial Sequence; identical to SEQ ID NO: 66274
  derived and/or modified sequence opt1 from hemagglutinin__InfluenzaA__ADM95843

SEQ ID NO: 66928 - RNA, 1701 nt, Artificial Sequence; identical to SEQ ID NO: 66274
  derived and/or modified sequence opt1 from hemagglutinin__InfluenzaA__ADM95844

SEQ ID NO: 66929 - RNA, 1701 nt, Artificial Sequence
  derived and/or modified sequence opt1 from hemagglutinin__InfluenzaA__ADM95845
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggagaccaagcugaaccgggaggagaucgacggcgugaagcuggagagcacccgcaucuaccagauccucgccaucuacuccaccgucgcgagcagccuggugcugguggucucccucggggccaucagcuucuggaugugcuccaacggcagccugcagugccggaucugcaucuga

SEQ ID NO: 66930 - RNA, 1701 nt, Artificial Sequence
  derived and/or modified sequence opt1 from hemagglutinin__InfluenzaA__ADM95846
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggaggccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacaucccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 66931 - RNA, 1701 nt, Artificial Sequence; identical to SEQ ID NO: 64778
  derived and/or modified sequence opt1 from hemagglutinin__InfluenzaA__ADM95847

SEQ ID NO: 66932 - RNA, 1701 nt, Artificial Sequence; identical to SEQ ID NO: 64778
  derived and/or modified sequence opt1 from hemagglutinin__InfluenzaA__ADM95848

SEQ ID NO: 66933 - RNA, 1701 nt, Artificial Sequence
  derived and/or modified sequence opt1 from hemagglutinin__InfluenzaA__ADM95849
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucgugaucucccugggggccaucagcuucuggaugugcuccaacggcagccugcagugccggaucugcaucuga

SEQ ID NO: 66934 - RNA, 1701 nt, Artificial Sequence; identical to SEQ ID NO: 66274
  derived and/or modified sequence opt1 from hemagglutinin__InfluenzaA__ADM95850

SEQ ID NO: 66935 - RNA, 1701 nt, Artificial Sequence
  derived and/or modified sequence opt1 from hemagglutinin__InfluenzaA__ADM95851
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccaccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacaucccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 66936 - RNA, 1701 nt, Artificial Sequence
  derived and/or modified sequence opt1 from hemagglutinin__InfluenzaA__ADM95852
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagauccgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 66937 - RNA, 1701 nt, Artificial Sequence; identical to SEQ ID NO: 65097
  derived and/or modified sequence opt1 from hemagglutinin__InfluenzaA__ADM95854

SEQ ID NO: 66938 - RNA, 1701 nt, Artificial Sequence
  derived and/or modified sequence opt1 from hemagglutinin__InfluenzaA__ADM95855
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 66939 - RNA, 1701 nt, Artificial Sequence
  derived and/or modified sequence opt1 from hemagglutinin__InfluenzaA__ADM95857
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggauggcgaccggccuccgcaacgucccgagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccuccagccuggugcugguggucagccucggggccaucuccuucuggaugugcagcaacggcucccugcagugccggaucugcaucuga

SEQ ID NO: 66940 - RNA, 1701 nt, Artificial Sequence; identical to SEQ ID NO: 65359
  derived and/or modified sequence opt1 from hemagglutinin__InfluenzaA__ADM95858

SEQ ID NO: 66941 - RNA, 1701 nt, Artificial Sequence
  derived and/or modified sequence opt1 from hemagglutinin__InfluenzaA__ADM95859
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 66942 - RNA, 1701 nt, Artificial Sequence; identical to SEQ ID NO: 65304
  derived and/or modified sequence opt1 from hemagglutinin__InfluenzaA__ADM95860

SEQ ID NO: 66943 - RNA, 1701 nt, Artificial Sequence; identical to SEQ ID NO: 66904
  derived and/or modified sequence opt1 from hemagglutinin__InfluenzaA__ADM95862

SEQ ID NO: 66944 - RNA, 1701 nt, Artificial Sequence
  derived and/or modified sequence opt1 from hemagglutinin__InfluenzaA__ADM95864
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgcggguccgcgaccaggagggccggaugaacuaccacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 66945 - RNA, 1701 nt, Artificial Sequence; identical to SEQ ID NO: 65229
  derived and/or modified sequence opt1 from hemagglutinin__InfluenzaA__ADM95865

SEQ ID NO: 66946 - RNA, 1701 nt, Artificial Sequence
  derived and/or modified sequence opt1 from hemagglutinin__InfluenzaA__ADM95866
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaucuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgugaccggccugcgcaacgugccguccauccagagccgggggcuguucggcgccaucgcgggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccgccgcgagcagccuggugcucguggucucccugggggccaucagcuucuggaugugcuccaacggcagccugcagugccggaucugcaucuga

SEQ ID NO: 66947 - RNA, 1698 nt, Artificial Sequence; identical to SEQ ID NO: 66521
  derived and/or modified sequence opt1 from hemagglutinin__InfluenzaA__ADN06300

SEQ ID NO: 66948 - RNA, 1698 nt, Artificial Sequence
  derived and/or modified sequence opt1 from hemagglutinin__InfluenzaA__ADN06311
augaaggugaagcugcucguccugcugugcacccucaccgccacguacgccgacaccaucugcaucggcuaccacgcgaacaacagcaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggagcuacaucguggagaagcccaaccccgagaacgggaccugcuaccccggccacuucgccgacuacgaggagcuccgcgagcagcuguccagcguguccagcuucgagcgguucgagaucuucccgaagggcuccagcuggcccaaccacacggucaccggcguguccgccagcugcucccacaacggggagaacagcuucuaccgcaaccugcucuggcugaccggcaagaacgggcuguaccccaaccucuccaagagcuacgccaacaacaaggagaaggaggugcugguccuguggggcgugcaccacccgcccaacaucgccgaccagaagacccucuaccacacggagaacgccuacguguccgucgugagcagccacuacucccggaaguucacccccgagaucgccaagcgccccaaggugcgggaccaggagggccgcaucaacuacuacuggacccugcuggagcccggggacaccaucaucuucgaggcgaacggcaaccucaucgccccgcgguacgccuucgcccugagccgcggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacgcagaacgccaucaacggcaucaccaacaaggugaacagcgucaucgagaagaugaacacccaguucaccgccguggggaaggaguucaacaagcucgagcggcgcauggagaaccugaacaagaaggucgacgacggcuucaucgacaucuggacguacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccaccguggccagcagccucgugcugcuggucucccucggggccaucagcuucuggaugugcuccaacggcagccugcagugccggaucugcaucuga

SEQ ID NO: 66949 - RNA, 1698 nt, Artificial Sequence
  derived and/or modified sequence opt1 from hemagglutinin__InfluenzaA__ADN06322
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaugguggaccagcggacccuguaccgcacggagaacgccuacgucagcguggugagcucccacuacagccggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 66950 - RNA, 1698 nt, Artificial Sequence
  derived and/or modified sequence opt1 from hemagglutinin__InfluenzaA__ADN06344
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgagagcaugggcgucuaccagauccuggcgaucuacuccaccguggccagcucccuggugcuccuggucagccugggcgccaucuccuucuggaugugcagcaacgggucccuccagugccggaucugcaucuga

SEQ ID NO: 66951 - RNA, 1701 nt, Artificial Sequence; identical to SEQ ID NO: 66541
  derived and/or modified sequence opt1 from hemagglutinin__InfluenzaA__ADN06366

SEQ ID NO: 66952 - RNA, 1701 nt, Artificial Sequence
  derived and/or modified sequence opt1 from hemagglutinin__InfluenzaA__ADN26165
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucaucaagaagggcaacagcuaccccaagcuguccaagagcuacaucaacgacaaggggaaggaggugcuggugcucuggggcauccaccaccccagcaccuccgccgaccagcagagccuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcgcgcgcaucuaccagauccuggccaucuacuccaccguggccagcagccuggugcucgucgugucccugggcgccaucagcuucuggaugugcuccaacggcagccugcagugccggaucugcaucuga

SEQ ID NO: 66953 - RNA, 1701 nt, Artificial Sequence; identical to SEQ ID NO: 63857
  derived and/or modified sequence opt1 from hemagglutinin__InfluenzaA__ADN26175

SEQ ID NO: 66954 - RNA, 1701 nt, Artificial Sequence
  derived and/or modified sequence opt1 from hemagglutinin__InfluenzaA__ADN78194
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggccuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggccaucuacuccaccgucgcgagcagccucgugcugguggucucccugggggccaucagcuucuggaugugcuccaacggcagccuccagugccggaucugcaucuga

SEQ ID NO: 66955 - RNA, 1701 nt, Artificial Sequence; identical to SEQ ID NO: 64841
  derived and/or modified sequence opt1 from hemagglutinin__InfluenzaA__ADN78195

SEQ ID NO: 66956 - RNA, 1701 nt, Artificial Sequence; identical to SEQ ID NO: 65229
  derived and/or modified sequence opt1 from hemagglutinin__InfluenzaA__ADN78212

SEQ ID NO: 66957 - RNA, 1701 nt, Artificial Sequence; identical to SEQ ID NO: 65229
  derived and/or modified sequence opt1 from hemagglutinin__InfluenzaA__ADN78221

SEQ ID NO: 66958 - RNA, 1698 nt, Artificial Sequence; identical to SEQ ID NO: 66948
  derived and/or modified sequence opt1 from hemagglutinin__InfluenzaA__ADN89050

SEQ ID NO: 66959 - RNA, 1698 nt, Artificial Sequence
  derived and/or modified sequence opt1 from hemagglutinin__InfluenzaA__ADN89061
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgagaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagaaccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggcgaucuacagcaccguggccuccagccuggugcuccuggucucccugggggccaucagcuucuggaugugcuccaacggcagccuccagugccggaucugcaucuga

SEQ ID NO: 66960 - RNA, 1698 nt, Artificial Sequence; identical to SEQ ID NO: 66950
  derived and/or modified sequence opt1 from hemagglutinin__InfluenzaA__ADN89072

SEQ ID NO: 66961 - RNA, 1698 nt, Artificial Sequence
  derived and/or modified sequence opt1 from hemagglutinin__InfluenzaA__ADN89083
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacauggccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccagcagccuggugcuccuggucucccugggcgccaucagcuucuggaugugcuccaacgggagccuccagugccggaucugcaucuga

SEQ ID NO: 66962 - RNA, 1698 nt, Artificial Sequence
  derived and/or modified sequence opt1 from hemagglutinin__InfluenzaA__ADN89094
augaaggugaagcugcucguccugcugugcaccuucaccgccacguacgccgacaccaucugcaucggcuaccacgcgaacaacagcaccgacaccguggacacggcccucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggcgucuccgccagcugcucccacaacggcgagaacagcuucuaccgcaaccugcuguggcucaccgggaagaacggccuguaccccaaccuguccaagagcuacgccaacaacaaggggaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggggacaccaucaucuucgaggccaacggcaaccugaucgccccgcgguacgccuucgcccucagccgcggguucggcuccggcaucaucaacagcaacgcgcccauggacaagugcgacgccaagugccagacgccccagggggccaucaacuccagccugcccuuccagaacgugcacccggucaccaucggcgagugccccaaguacgugcgguccgccaagcugcgcauggugaccgggcuccggaacauccccagcauccagucccgcggccuguucggggccaucgcgggcuucaucgagggcggguggaccggcauggucgacgggugguacggcuaccaccaccagaacgagcaggggagcggcuacgccgccgaccagaaguccacgcagaacgccaucaacggcaucaccaacaaggugaacagcgugaucgagaagaugaacacccaguucaccgccgucgggaaggaguucaacaagcuggagcggcgcauggagaaccucaacaagaagguggacgacggcuucaucgacaucuggacguacaacgcggagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcguguaccagauccuggccaucuacuccaccgucgccagcagccuggugcuccuggugucccugggggccaucagcuucuggaugugcuccaacggcagccuccagugccggaucugcaucuga

SEQ ID NO: 66963 - RNA, 1698 nt, Artificial Sequence
  derived and/or modified sequence opt1 from hemagglutinin__InfluenzaA__ADN89116
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccagcugcucccacaacggcgagagcuccuucuaccgcaaccugcuguggcucaccgugaagaacgggcuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaaccuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccauggggguguaccagauccuggcgaucuacagcaccguggccagcucccugguccuccuggugagccugggcgccaucuccuucuggaugugcagcaacggcucccuccagugccggaucugcaucuga

SEQ ID NO: 66964 - RNA, 1698 nt, Artificial Sequence
  derived and/or modified sequence opt1 from hemagglutinin__InfluenzaA__ADN89127
augaaggugaagcugcucguccugcugugcacccucaccgccacguacgccgacaccaucugcaucggcuaccacgcgaacaacagcaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggagcuacaucguggagaagcccaaccccgagaacgggaccugcuaccccggccacuucgccgacuacgaggagcuccgcgagcagcuguccagcguguccagcuucgagcgguucgagaucuucccgaagggcuccagcuggcccaaccacacggucaccggcguguccgccagcugcucccacaacggggagaacagcuucuaccgcaaccugcucuggcugaccggcaagaacgggcuguaccccaaccucuccaagagcuacgccaacaacaaggagaaggaggugcugguccuguggggcgugcaccacccgcccaacaucgccgaccagaagacccucuaccacacggagaacgccuacguguccgucgugagcagccacuacucccggaaguucacccccgagaucgccaagcgccccaaggugcgggaccaggagggccgcaucaacuacuacuggacccugcuggagcccggggacaccaucaucuucgaggcgaacggcaaccucaucgccccgcgguacgccuucgcccugagccgcggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacgcagaacgccaucaacggcaucaccaacaaggugaacagcgucaucgagaagaugaacacccaguucaccgccguggggaaggaguucaacaagcucgagcggcgcauggagaaccugaacaagaaggucgacgacggcuucaucgacaucuggacguacaacgccgagcugcucgugcugcuggagaacgagcggacccucgacuuccacgacuccaacgugaagaaccuguacgagaaggucaagagccagcugaagaacaacgcggaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccaccguggccagcagccucgugcugcuggucucccucggggccaucagcuucuggaugugcuccaacggcagccugcagugccggaucugcaucuga

SEQ ID NO: 66965 - RNA, 1698 nt, Artificial Sequence
  derived and/or modified sequence opt1 from hemagglutinin__InfluenzaA__ADN89149
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagguggccaagcgccccaagguccgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccagggcgcgaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgagagcauggggguguaccagauccuggcgaucuacuccaccguggccagcucccugguccuccuggugagccugggcgccaucuccuucuggaugugcagcaacggcucccuccagugccggaucugcaucuga

SEQ ID NO: 66966 - RNA, 1698 nt, Artificial Sequence; identical to SEQ ID NO: 66521
  derived and/or modified sequence opt1 from hemagglutinin__InfluenzaA__ADN89171

SEQ ID NO: 66967 - RNA, 1698 nt, Artificial Sequence
  derived and/or modified sequence opt1 from hemagglutinin__InfluenzaA__ADN89182
augaaggugaagcugcucguccugcugugcacccucaccgccacguacgccgacaccaucugcaucggcuaccacgcgaacaacagcaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggagcuacaucguggagaagcccaaccccgagaacgggaccugcuaccccggccacuucgccgacuacgaggagcuccgcgagcagcuguccagcguguccagcuucgagcgguucgagaucuucccgaaggaguccagcuggcccaaccacacggucaccgggguguccgccagcugcucccacaacggcgagagcuccuucuaccgcaaccugcucuggcugaccgggaagaacggccuguaccccaaccucagcaaguccuacgccaacaacaaggagaaggaggugcugguccuguggggcgugcaccacccgcccaacaucguggaccagaagacccucuaccggacggagaacgccuacgucagcguggugagcucccacuacagccgcaaguucacccccgagaucgccaagcggcccaagguccgcgaccaggagggccggaucaacuacuacuggacccugcuggagcccggcgacaccaucaucuucgaggccaacgggaaccucaucgcgccgcgcuacgccuucgcccugucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcuccggauggugaccggccugcgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcucgagcgccggauggagaaccugaacaagaagguggacgacggguucaucgacaucuggacguacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcucaaccgggagaagaucgacggggucaagcuggaguccaugggcguguaccagauccuggcgaucuacagcaccguggccagcucccucguccugcuggugagccucggcgccaucuccuucuggaugugcagcaacgggucccugcagugccgcaucugcaucuga

SEQ ID NO: 66968 - RNA, 1698 nt, Artificial Sequence; identical to SEQ ID NO: 66521
  derived and/or modified sequence opt1 from hemagglutinin__InfluenzaA__ADN89193

SEQ ID NO: 66969 - RNA, 1698 nt, Artificial Sequence; identical to SEQ ID NO: 66521
  derived and/or modified sequence opt1 from hemagglutinin__InfluenzaA__ADN89204

SEQ ID NO: 66970 - RNA, 1698 nt, Artificial Sequence; identical to SEQ ID NO: 66948
  derived and/or modified sequence opt1 from hemagglutinin__InfluenzaA__ADN89215

SEQ ID NO: 66971 - RNA, 1698 nt, Artificial Sequence
  derived and/or modified sequence opt1 from hemagglutinin__InfluenzaA__ADN89226
augaaggugaagcugcucguccugcugugcaccuucgccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacaccgagaacgccuacguguccgucgugagcucccacuacagccggaaguucacgcccgagaucgccaagcgccccaaggugcgggaccaggaggggcgcaucaacuacuacuggacccuccuggagcccggcgacaccaucaucuucgaggcgaacggcaaccugaucgccccgcgguacgccuucgcccucaaccgcggguucggcuccgggaucaucaacagcaacgcccccauggacaagugcgacgcgaagugccagacgccccagggcgccaucaacuccagccugcccuuccagaacguccacccggugaccaucggcgagugccccaaguacgugcgguccgccaagcugcgcauggucaccgggcuccggaacauccccagcgugcagucccgcggccuguucggggccaucgccggcuucaucgagggcggcuggaccggcaugguggacgggugguacggcuaccaccaccagaacgagcaggggagcggcuacgcggccgaccagaaguccacccagaacgccaucaacgggaucacgaacaaggucaacagcgugaucgagaagaugaacacccaguucaccgccgucggcaaggaguucaacaagcuggagcggcgcauggagaaccucaacaagaagguggacgacggcuucaucgacaucuggaccuacaacgccgagcugcuggugcuccuggagaacgagcggacgcuggacuuccacgacuccaacgucaagaaccucuacgagaaggugaagaaccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccauggggguguaccagauccuggccaucuacagcaccguggccagcucccugguccuccuggugagccugggcgccaucuccuucuggaugugcagcaacggcucccuccagugccggaucugcaucuga

SEQ ID NO: 66972 - RNA, 1698 nt, Artificial Sequence; identical to SEQ ID NO: 66948
  derived and/or modified sequence opt1 from hemagglutinin__InfluenzaA__ADN89237

SEQ ID NO: 66973 - RNA, 1698 nt, Artificial Sequence
  derived and/or modified sequence opt1 from hemagglutinin__InfluenzaA__ADN89248
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccaucgccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccagcugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccagcaucagcgaccagaagacccuguaccacacggagaacgccuacguguccguggucagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggucaccaucggggagugccccaaguacgugcggagcgccaagcugcgcauggugaccggccuccggaacauccccuccauccagagccgcgggcuguucggcgccaucgccggguucaucgagggcggcuggaccgggauggucgacggcugguacggguaccaccaccagaacgagcagggcuccggguacgccgcggaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagagcaagcugaaccgcgagaagaucgacggggugaagcucgagagcaugggcguguaccagauccuggcgaucuacuccaccgucgccagcucccuggugcuccuggugagccugggcgccaucuccuucuggaugugcagcaacgggucccuccagugccggaucugcaucuga

SEQ ID NO: 66974 - RNA, 1698 nt, Artificial Sequence; identical to SEQ ID NO: 66961
  derived and/or modified sequence opt1 from hemagglutinin__InfluenzaA__ADN89259

SEQ ID NO: 66975 - RNA, 1698 nt, Artificial Sequence
  derived and/or modified sequence opt1 from hemagglutinin__InfluenzaA__ADN89281
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggggucuaccagauccuggcgaucuacagcaccguggccuccagccuggugcuccuggucucccugggcgccaucagcuucuggaugugcuccaacggcagccuccagugccggaucugcaucuga

SEQ ID NO: 66976 - RNA, 1698 nt, Artificial Sequence; identical to SEQ ID NO: 66975
  derived and/or modified sequence opt1 from hemagglutinin__InfluenzaA__ADN89292

SEQ ID NO: 66977 - RNA, 1698 nt, Artificial Sequence; identical to SEQ ID NO: 66975
  derived and/or modified sequence opt1 from hemagglutinin__InfluenzaA__ADN89303

SEQ ID NO: 66978 - RNA, 1698 nt, Artificial Sequence; identical to SEQ ID NO: 64634
  derived and/or modified sequence opt1 from hemagglutinin__InfluenzaA__ADN89314

SEQ ID NO: 66979 - RNA, 1698 nt, Artificial Sequence; identical to SEQ ID NO: 64139
  derived and/or modified sequence opt1 from hemagglutinin__InfluenzaA__ADN89325

SEQ ID NO: 66980 - RNA, 1698 nt, Artificial Sequence
  derived and/or modified sequence opt1 from hemagglutinin__InfluenzaA__ADN89336
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuaccggaaccugcuguggcucaccgggaagaacggccuguaccccaaccuguccaagagcuacgccaacaacaaggagaaggaggugcucguccuguggggcgugcaccacccgcccgacaucggcgaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucagccggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccagcagccuggugcuccuggucucccugggggccaucagcuucuggaugugcuccaacggcagccuccagugccgcaucugcaucuga

SEQ ID NO: 66981 - RNA, 1698 nt, Artificial Sequence; identical to SEQ ID NO: 66971
  derived and/or modified sequence opt1 from hemagglutinin__InfluenzaA__ADN89347

SEQ ID NO: 66982 - RNA, 1698 nt, Artificial Sequence; identical to SEQ ID NO: 64139
  derived and/or modified sequence opt1 from hemagglutinin__InfluenzaA__ADN89358

SEQ ID NO: 66983 - RNA, 1698 nt, Artificial Sequence
  derived and/or modified sequence opt1 from hemagglutinin__InfluenzaA__ADN89369
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucauccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 66984 - RNA, 1698 nt, Artificial Sequence
  derived and/or modified sequence opt1 from hemagglutinin__InfluenzaA__ADN89380
augaaggugaagcugcucguccugcugugcacccucaccgccacguacgccgacaccaucugcaucggcuaccacgcgaacaacagcaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggagcuacaucguggagaagcccaaccccgagaacgggaccugcuaccccggccacuucgccgacuacgaggagcuccgcgagcagcuguccagcguguccagcuucgagcgguucgagaucuucccgaaggaguccagcuggcccaaccacacggucaccgggguguccgccagcugcucccacaacggcgagagcuccuucuaccgcaaccugcucuggcugaccgggaagaacggccuguaccccaaccucagcaaguccuacgccaacaacaaggagaaggaggugcugguccuguggggcgugcaccacccgcccaacaucguggaccagaagacccucuaccggacggagaacgccuacgucagcguggugagcucccacuacagccgcaaguucacccccgagaucgccaagcggcccaagguccgcgaccaggagggccggaucaacuacuacuggacccugcuggagcccggcgacaccaucaucuucgaggccaacgggaaccucaucgcgccgcgcuacgccuucgcccugucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcuccggauggugaccggccugcgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcucgagcgccggauggagaaccugaacaagaagguggacgacggguucaucgacaucuggacguacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcucaaccgggagaagaucgacggggucaagcuggaguccaugggcguguaccagauccuggcgaucuacagcaccguggccagcucccucguccugcuggugagccucggcgccaucuccuucuggaugugcagcaacgggucccugcagugccgcaucugcaucuga

SEQ ID NO: 66985 - RNA, 1698 nt, Artificial Sequence
  derived and/or modified sequence opt1 from hemagglutinin__InfluenzaA__ADN89391
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuacaagaaccugcuguggcucaccgggaagaacggccuguaccccaaccuguccaagagcuacgccaacaacaaggagaaggaggugcucguccuguggggcgugcaccacccgcccgacaucggcgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacuccaccguggccagcagccuggugcuccuggucucccugggggccaucagcuucuggaugugcuccaacggcagccuccagugccggaucugcaucuga

SEQ ID NO: 66986 - RNA, 1698 nt, Artificial Sequence
  derived and/or modified sequence opt1 from hemagglutinin__InfluenzaA__ADN89402
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaagaaguccuggagcuacaucguggagaagcccaaccccgagaacgggaccugcuaccccggccacuucgccgacuacgaggagcugaaggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgccaacaacaaggagaaggaggugcucguccuguggggcgugcaccacccgcccaacaucguggaccagaagacccuguaccgcacggagaacgccuacgucagcguggugagcucccacuacagccggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 66987 - RNA, 1698 nt, Artificial Sequence; identical to SEQ ID NO: 66948
  derived and/or modified sequence opt1 from hemagglutinin__InfluenzaA__ADN89413

SEQ ID NO: 66988 - RNA, 1698 nt, Artificial Sequence; identical to SEQ ID NO: 66521
  derived and/or modified sequence opt1 from hemagglutinin__InfluenzaA__ADN89424

SEQ ID NO: 66989 - RNA, 1698 nt, Artificial Sequence
  derived and/or modified sequence opt1 from hemagglutinin__InfluenzaA__ADN89435
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggagucccgccugaaccgggagaagaucgacggggugaagcucgagagcaugggcgucuaccagauccuggccaucuacuccaccguggccagcagccuggugcuccuggucucccugggcgccaucagcuucuggaugugcuccaacgggagccuccagugccgcaucugcaucuga

SEQ ID NO: 66990 - RNA, 1698 nt, Artificial Sequence
  derived and/or modified sequence opt1 from hemagglutinin__InfluenzaA__ADN89446
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccgucgccagcagccuggugcuccuggugucccugggcgccaucagcuucuggaugugcuccaacgggagccuccagugccggaucugcaucuga

SEQ ID NO: 66991 - RNA, 1698 nt, Artificial Sequence; identical to SEQ ID NO: 66521
  derived and/or modified sequence opt1 from hemagglutinin__InfluenzaA__ADN89457

SEQ ID NO: 66992 - RNA, 1698 nt, Artificial Sequence
  derived and/or modified sequence opt1 from hemagglutinin__InfluenzaA__ADN89468
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggacuccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucaacgaccagaagacccuguaccacacggagaacgccuacgugagcgucguguccagccacuacucccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucagccgcggcuucggguccggcaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucuccaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgagagcaugggcgucuaccagauccugaccaucuacuccacgguggcgagcucccuggugcuccugaucagccugggcgccaucuccuucuggaugugcagcaacgggucccuccagugccggaucugcaucuga

SEQ ID NO: 66993 - RNA, 1698 nt, Artificial Sequence; identical to SEQ ID NO: 66950
  derived and/or modified sequence opt1 from hemagglutinin__InfluenzaA__ADN89479

SEQ ID NO: 66994 - RNA, 1698 nt, Artificial Sequence; identical to SEQ ID NO: 66950
  derived and/or modified sequence opt1 from hemagglutinin__InfluenzaA__ADN89490

SEQ ID NO: 66995 - RNA, 1698 nt, Artificial Sequence; identical to SEQ ID NO: 66973
  derived and/or modified sequence opt1 from hemagglutinin__InfluenzaA__ADN89501

SEQ ID NO: 66996 - RNA, 1698 nt, Artificial Sequence; identical to SEQ ID NO: 66961
  derived and/or modified sequence opt1 from hemagglutinin__InfluenzaA__ADN89512

SEQ ID NO: 66997 - RNA, 1698 nt, Artificial Sequence; identical to SEQ ID NO: 66975
  derived and/or modified sequence opt1 from hemagglutinin__InfluenzaA__ADN89523

SEQ ID NO: 66998 - RNA, 1698 nt, Artificial Sequence; identical to SEQ ID NO: 66984
  derived and/or modified sequence opt1 from hemagglutinin__InfluenzaA__ADN89534

SEQ ID NO: 66999 - RNA, 1698 nt, Artificial Sequence; identical to SEQ ID NO: 66989
  derived and/or modified sequence opt1 from hemagglutinin__InfluenzaA__ADN89545

SEQ ID NO: 67000 - RNA, 1698 nt, Artificial Sequence; identical to SEQ ID NO: 64634
  derived and/or modified sequence opt1 from hemagglutinin__InfluenzaA__ADN89556

SEQ ID NO: 67001 - RNA, 1698 nt, Artificial Sequence; identical to SEQ ID NO: 66950
  derived and/or modified sequence opt1 from hemagglutinin__InfluenzaA__ADN89567

SEQ ID NO: 67002 - RNA, 1698 nt, Artificial Sequence
  derived and/or modified sequence opt1 from hemagglutinin__InfluenzaA__ADN89578
augaaggugaagcugcucguccugcugugcacccucaccgccacguacgccgacaccaucugcaucggcuaccacgcgaacaacagcaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggagcuacaucguggagaagcccaaccccgagaacgggaccugcuaccccggccacuucgccgacuacgaggagcuccgcgagcagcuguccagcguguccagcuucgagcgguucgagaucuucccgaagggcuccagcuggcccaaccacacggucaccggcguguccgccagcugcucccacaacggggagaacagcuucuaccgcaaccugcucuggcugaccggcaagaacgggcuguaccccaaccucuccaagagcuacgccaacaacaaggagaaggaggugcugcugcucuggggcguccaccacccgcccaacaucgccgaccagaagacccuguaccacacggagaacgccuacguguccguggucagcagccacuacucccggaaguucacccccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugagccgcggguucggcuccggcaucaucaacagcaacgcccccauggacaagugcgacgcgaagugccagacgccccagggggccaucaacuccagccuccccuuccagaacgugcacccggucaccaucggcgagugccccaaguacgugcgguccgccaagcugcgcauggugaccgggcugcggaacauccccagcauccagucccgcggccucuucggggccaucgccggcuucaucgagggcggguggaccggcauggucgacgggugguacggcuaccaccaccagaacgagcaggggagcggcuacgcggccgaccagaaguccacgcagaacgccaucaacggcaucaccaacaaggugaacagcgugaucgagaagaugaacacccaguucaccgccgucgggaaggaguucaacaagcuggagcggcgcauggagaaccugaacaagaagguggacgacggcuucaucgacaucuggacguacaacgccgagcuccugguccugcucgagaacgagcggacccuggacuuccacgacuccaacgugaagaaccuguacgagaaggucaagagccagcucaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcuggagagcaugggcguguaccagauccucgccaucuacuccaccgucgccagcagccuggugcugcucgugucccugggggccaucagcuucuggaugugcuccaacggcagccugcagugccggaucugcaucuga

SEQ ID NO: 67003 - RNA, 1698 nt, Artificial Sequence; identical to SEQ ID NO: 66521
  derived and/or modified sequence opt1 from hemagglutinin__InfluenzaA__ADN89589

SEQ ID NO: 67004 - RNA, 1698 nt, Artificial Sequence
  derived and/or modified sequence opt1 from hemagglutinin__InfluenzaA__ADN89600
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccagcugcucccacaacggcgagagcuccuucuaccgcaaccugcuguggcucacccggaagaacgggcuguaccccaaccugagcaaguccuacgccaacaacaaggagaaggaggugcucguccuguggggcgugcaccacccgcccaacaugguggaccagaagacccuguaccgcacggagaacgccuacgucagcguggugagcucccacuacagccggaaguucacccccgagaucgccaagcgccccaagguccgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccaugggcaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggucaagcucgaguccaugggcguguaccagauccuggcgaucuacagcaccguggccagcucccugguccuccuggugagccugggcgccaucuccuucuggaugugcagcaacgggucccuccagugccggaucugcaucuga

SEQ ID NO: 67005 - RNA, 1698 nt, Artificial Sequence; identical to SEQ ID NO: 66521
  derived and/or modified sequence opt1 from hemagglutinin__InfluenzaA__ADN89611

SEQ ID NO: 67006 - RNA, 1698 nt, Artificial Sequence; identical to SEQ ID NO: 66948
  derived and/or modified sequence opt1 from hemagglutinin__InfluenzaA__ADN89622

SEQ ID NO: 67007 - RNA, 1698 nt, Artificial Sequence; identical to SEQ ID NO: 66989
  derived and/or modified sequence opt1 from hemagglutinin__InfluenzaA__ADN89633

SEQ ID NO: 67008 - RNA, 1698 nt, Artificial Sequence; identical to SEQ ID NO: 66973
  derived and/or modified sequence opt1 from hemagglutinin__InfluenzaA__ADN89644

SEQ ID NO: 67009 - RNA, 1698 nt, Artificial Sequence; identical to SEQ ID NO: 66989
  derived and/or modified sequence opt1 from hemagglutinin__InfluenzaA__ADN89655

SEQ ID NO: 67010 - RNA, 1698 nt, Artificial Sequence; identical to SEQ ID NO: 66521
  derived and/or modified sequence opt1 from hemagglutinin__InfluenzaA__ADN89666

SEQ ID NO: 67011 - RNA, 1698 nt, Artificial Sequence; identical to SEQ ID NO: 66961
  derived and/or modified sequence opt1 from hemagglutinin__InfluenzaA__ADN89677

SEQ ID NO: 67012 - RNA, 1698 nt, Artificial Sequence; identical to SEQ ID NO: 66961
  derived and/or modified sequence opt1 from hemagglutinin__InfluenzaA__ADN89688

SEQ ID NO: 67013 - RNA, 1698 nt, Artificial Sequence; identical to SEQ ID NO: 66948
  derived and/or modified sequence opt1 from hemagglutinin__InfluenzaA__ADN89699

SEQ ID NO: 67014 - RNA, 1698 nt, Artificial Sequence; identical to SEQ ID NO: 66950
  derived and/or modified sequence opt1 from hemagglutinin__InfluenzaA__ADN89710

SEQ ID NO: 67015 - RNA, 1698 nt, Artificial Sequence; identical to SEQ ID NO: 66973
  derived and/or modified sequence opt1 from hemagglutinin__InfluenzaA__ADN89721

SEQ ID NO: 67016 - RNA, 1698 nt, Artificial Sequence; identical to SEQ ID NO: 66950
  derived and/or modified sequence opt1 from hemagglutinin__InfluenzaA__ADN89732

SEQ ID NO: 67017 - RNA, 1698 nt, Artificial Sequence; identical to SEQ ID NO: 66950
  derived and/or modified sequence opt1 from hemagglutinin__InfluenzaA__ADN89743

SEQ ID NO: 67018 - RNA, 1698 nt, Artificial Sequence; identical to SEQ ID NO: 66975
  derived and/or modified sequence opt1 from hemagglutinin__InfluenzaA__ADN89765

SEQ ID NO: 67019 - RNA, 1698 nt, Artificial Sequence
  derived and/or modified sequence opt1 from hemagglutinin__InfluenzaA__ADN89776
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagguggccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggucaagcucgagagcaugggcguguaccagauccuggcgaucuacuccaccguggccagcucccugguccuccuggugagccugggcgccaucuccuucuggaugugcagcaacgggucccuccagugccggaucugcaucuga

SEQ ID NO: 67020 - RNA, 1698 nt, Artificial Sequence; identical to SEQ ID NO: 66961
  derived and/or modified sequence opt1 from hemagglutinin__InfluenzaA__ADN89787

SEQ ID NO: 67021 - RNA, 1698 nt, Artificial Sequence; identical to SEQ ID NO: 66975
  derived and/or modified sequence opt1 from hemagglutinin__InfluenzaA__ADN89798

SEQ ID NO: 67022 - RNA, 1698 nt, Artificial Sequence; identical to SEQ ID NO: 66521
  derived and/or modified sequence opt1 from hemagglutinin__InfluenzaA__ADN89809

SEQ ID NO: 67023 - RNA, 1698 nt, Artificial Sequence; identical to SEQ ID NO: 66521
  derived and/or modified sequence opt1 from hemagglutinin__InfluenzaA__ADN89820

SEQ ID NO: 67024 - RNA, 1698 nt, Artificial Sequence; identical to SEQ ID NO: 66521
  derived and/or modified sequence opt1 from hemagglutinin__InfluenzaA__ADN89831

SEQ ID NO: 67025 - RNA, 1698 nt, Artificial Sequence
  derived and/or modified sequence opt1 from hemagglutinin__InfluenzaA__ADN89842
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaaccgccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuaccggaaccugcuguggcucaccgggaagaacggccuguaccccaaccuguccaagagcuacgccaacaacaaggagaaggaggugcucguccuguggggcgugcaccacccgcccaacaucguggaccagaagacccuguaccgcacggagaacgccuacgucuccguggugagcagccacuacucccggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucagccgcggcuucggguccggcaucaucaacagcaacgcccccauggacaagugcgacgccaagugccagacgccccagggcgcgaucaacuccagccugcccuuccagaacgugcacccggugaccaucggggagugccccaaguacguccgguccgccaagcugcgcauggugaccggccuccggaacauccccagcauccagucccgcgggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggcgaucuacuccaccguggccagcagccugguccuccuggugucccugggcgccaucagcuucuggaugugcuccaacgggagccuccagugccggaucugcaucuga

SEQ ID NO: 67026 - RNA, 1701 nt, Artificial Sequence; identical to SEQ ID NO: 66541
  derived and/or modified sequence opt1 from hemagglutinin__InfluenzaA__ADN89864

SEQ ID NO: 67027 - RNA, 1701 nt, Artificial Sequence; identical to SEQ ID NO: 66541
  derived and/or modified sequence opt1 from hemagglutinin__InfluenzaA__ADN89875

SEQ ID NO: 67028 - RNA, 1701 nt, Artificial Sequence
  derived and/or modified sequence opt1 from hemagglutinin__InfluenzaA__ADN89886
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagagcacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagacccgcaagcagcugcgcgagaacgcggaggacauggggaacggcugcuucaccaucuaccacaagugcgacaacgccugcaucgggagcauccggaacggcaccuacgaccacaacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 67029 - RNA, 1701 nt, Artificial Sequence; identical to SEQ ID NO: 66541
  derived and/or modified sequence opt1 from hemagglutinin__InfluenzaA__ADN89897

SEQ ID NO: 67030 - RNA, 1701 nt, Artificial Sequence; identical to SEQ ID NO: 66541
  derived and/or modified sequence opt1 from hemagglutinin__InfluenzaA__ADN89908

SEQ ID NO: 67031 - RNA, 1701 nt, Artificial Sequence; identical to SEQ ID NO: 66541
  derived and/or modified sequence opt1 from hemagglutinin__InfluenzaA__ADN89919

SEQ ID NO: 67032 - RNA, 1701 nt, Artificial Sequence; identical to SEQ ID NO: 66541
  derived and/or modified sequence opt1 from hemagglutinin__InfluenzaA__ADN89930

SEQ ID NO: 67033 - RNA, 1701 nt, Artificial Sequence; identical to SEQ ID NO: 66541
  derived and/or modified sequence opt1 from hemagglutinin__InfluenzaA__ADN89941

SEQ ID NO: 67034 - RNA, 1701 nt, Artificial Sequence; identical to SEQ ID NO: 66541
  derived and/or modified sequence opt1 from hemagglutinin__InfluenzaA__ADN89952

SEQ ID NO: 67035 - RNA, 1701 nt, Artificial Sequence; identical to SEQ ID NO: 66541
  derived and/or modified sequence opt1 from hemagglutinin__InfluenzaA__ADN89963

SEQ ID NO: 67036 - RNA, 1701 nt, Artificial Sequence
  derived and/or modified sequence opt1 from hemagglutinin__InfluenzaA__ADN89974
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucacguacggggcgugcccccgcuacgucaagcagagcacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccugaaguccacgcaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgcggaggacauggggaacggcugcuucaccaucuaccacaagugcgacaacgccugcaucgggagcauccgcaacggcaccuacgaccacaacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 67037 - RNA, 1701 nt, Artificial Sequence; identical to SEQ ID NO: 66541
  derived and/or modified sequence opt1 from hemagglutinin__InfluenzaA__ADN89985

SEQ ID NO: 67038 - RNA, 1701 nt, Artificial Sequence; identical to SEQ ID NO: 66541
  derived and/or modified sequence opt1 from hemagglutinin__InfluenzaA__ADN89996

SEQ ID NO: 67039 - RNA, 1701 nt, Artificial Sequence; identical to SEQ ID NO: 66541
  derived and/or modified sequence opt1 from hemagglutinin__InfluenzaA__ADN90007

SEQ ID NO: 67040 - RNA, 1701 nt, Artificial Sequence; identical to SEQ ID NO: 66541
  derived and/or modified sequence opt1 from hemagglutinin__InfluenzaA__ADN90018

SEQ ID NO: 67041 - RNA, 1701 nt, Artificial Sequence; identical to SEQ ID NO: 66541
  derived and/or modified sequence opt1 from hemagglutinin__InfluenzaA__ADN90040

SEQ ID NO: 67042 - RNA, 1701 nt, Artificial Sequence; identical to SEQ ID NO: 66541
  derived and/or modified sequence opt1 from hemagglutinin__InfluenzaA__ADN90051

SEQ ID NO: 67043 - RNA, 1701 nt, Artificial Sequence; identical to SEQ ID NO: 66541
  derived and/or modified sequence opt1 from hemagglutinin__InfluenzaA__ADN90062

SEQ ID NO: 67044 - RNA, 1701 nt, Artificial Sequence; identical to SEQ ID NO: 66541
  derived and/or modified sequence opt1 from hemagglutinin__InfluenzaA__ADN90073

SEQ ID NO: 67045 - RNA, 1701 nt, Artificial Sequence; identical to SEQ ID NO: 66541
  derived and/or modified sequence opt1 from hemagglutinin__InfluenzaA__ADN90084

SEQ ID NO: 67046 - RNA, 1701 nt, Artificial Sequence; identical to SEQ ID NO: 66541
  derived and/or modified sequence opt1 from hemagglutinin__InfluenzaA__ADN90095

SEQ ID NO: 67047 - RNA, 1701 nt, Artificial Sequence; identical to SEQ ID NO: 66541
  derived and/or modified sequence opt1 from hemagglutinin__InfluenzaA__ADN90106

SEQ ID NO: 67048 - RNA, 1701 nt, Artificial Sequence; identical to SEQ ID NO: 66541
  derived and/or modified sequence opt1 from hemagglutinin__InfluenzaA__ADN90117

SEQ ID NO: 67049 - RNA, 1701 nt, Artificial Sequence; identical to SEQ ID NO: 66541
  derived and/or modified sequence opt1 from hemagglutinin__InfluenzaA__ADN90128

SEQ ID NO: 67050 - RNA, 1701 nt, Artificial Sequence; identical to SEQ ID NO: 66541
  derived and/or modified sequence opt1 from hemagglutinin__InfluenzaA__ADN90139

SEQ ID NO: 67051 - RNA, 1701 nt, Artificial Sequence; identical to SEQ ID NO: 66541
  derived and/or modified sequence opt1 from hemagglutinin__InfluenzaA__ADN90150

SEQ ID NO: 67052 - RNA, 1701 nt, Artificial Sequence; identical to SEQ ID NO: 66541
  derived and/or modified sequence opt1 from hemagglutinin__InfluenzaA__ADN90161

SEQ ID NO: 67053 - RNA, 1701 nt, Artificial Sequence; identical to SEQ ID NO: 66541
  derived and/or modified sequence opt1 from hemagglutinin__InfluenzaA__ADN90172

SEQ ID NO: 67054 - RNA, 1701 nt, Artificial Sequence; identical to SEQ ID NO: 66541
  derived and/or modified sequence opt1 from hemagglutinin__InfluenzaA__ADN90183

SEQ ID NO: 67055 - RNA, 1701 nt, Artificial Sequence; identical to SEQ ID NO: 66541
  derived and/or modified sequence opt1 from hemagglutinin__InfluenzaA__ADN90194

SEQ ID NO: 67056 - RNA, 1701 nt, Artificial Sequence; identical to SEQ ID NO: 66541
  derived and/or modified sequence opt1 from hemagglutinin__InfluenzaA__ADN90205

SEQ ID NO: 67057 - RNA, 1701 nt, Artificial Sequence; identical to SEQ ID NO: 66541
  derived and/or modified sequence opt1 from hemagglutinin__InfluenzaA__ADN90216

SEQ ID NO: 67058 - RNA, 1701 nt, Artificial Sequence; identical to SEQ ID NO: 64438
  derived and/or modified sequence opt1 from hemagglutinin__InfluenzaA__ADN92467

SEQ ID NO: 67059 - RNA, 1701 nt, Artificial Sequence
  derived and/or modified sequence opt1 from hemagglutinin__InfluenzaA__ADN92478
augaagaccaucaucgcccugagccacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugauccccaacaucggcagccggccgcgcguccggaacauccccucccgcaucagcaucuacuggaccaucgugaagcccggcgacauccugcucaucaacuccaccgggaaccugaucgcgccccggggcuacuucaagauccagagcgggaaguccagcaucaugcgcuccgacgccccgaucggcaagugcaacagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 67060 - RNA, 1701 nt, Artificial Sequence
  derived and/or modified sequence opt1 from hemagglutinin__InfluenzaA__ADN92489
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagaacuucaacuggaccggggugacccagaacggcaccagcuccgccugcauccgccggagcaagaacuccuucuucagccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgugauccccaacaucggcagccggccgcgcguccggaacauccccagccgcaucuccaucuacuggaccaucgugaagcccggcgacauccugcucaucaacagcaccgggaaccugaucgcgccccggggcuacuucaagauccaguccgggaaguccuccaucaugcgcagcgacgccccgaucggcaagugcaacuccgagugcaucacgcccaacggcagcauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 67061 - RNA, 1701 nt, Artificial Sequence; identical to SEQ ID NO: 64438
  derived and/or modified sequence opt1 from hemagglutinin__InfluenzaA__ADN92500

SEQ ID NO: 67062 - RNA, 1701 nt, Artificial Sequence; identical to SEQ ID NO: 63677
  derived and/or modified sequence opt1 from hemagglutinin__InfluenzaA__ADN92510

SEQ ID NO: 67063 - RNA, 1701 nt, Artificial Sequence; identical to SEQ ID NO: 63677
  derived and/or modified sequence opt1 from hemagglutinin__InfluenzaA__ADN92520

SEQ ID NO: 67064 - RNA, 1701 nt, Artificial Sequence; identical to SEQ ID NO: 64779
  derived and/or modified sequence opt1 from hemagglutinin__InfluenzaA__ADN92530

SEQ ID NO: 67065 - RNA, 1701 nt, Artificial Sequence; identical to SEQ ID NO: 63919
  derived and/or modified sequence opt1 from hemagglutinin__InfluenzaA__ADN92540

SEQ ID NO: 67066 - RNA, 1701 nt, Artificial Sequence; identical to SEQ ID NO: 63677
  derived and/or modified sequence opt1 from hemagglutinin__InfluenzaA__ADN92550

SEQ ID NO: 67067 - RNA, 1701 nt, Artificial Sequence; identical to SEQ ID NO: 63677
  derived and/or modified sequence opt1 from hemagglutinin__InfluenzaA__ADN92560

SEQ ID NO: 67068 - RNA, 1701 nt, Artificial Sequence
  derived and/or modified sequence opt1 from hemagglutinin__InfluenzaA__ADO00730
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacggcaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 67069 - RNA, 1701 nt, Artificial Sequence; identical to SEQ ID NO: 65097
  derived and/or modified sequence opt1 from hemagglutinin__InfluenzaA__ADO00740

SEQ ID NO: 67070 - RNA, 1701 nt, Artificial Sequence; identical to SEQ ID NO: 64841
  derived and/or modified sequence opt1 from hemagglutinin__InfluenzaA__ADO00750

SEQ ID NO: 67071 - RNA, 1701 nt, Artificial Sequence; identical to SEQ ID NO: 63677
  derived and/or modified sequence opt1 from hemagglutinin__InfluenzaA__ADO12143

SEQ ID NO: 67072 - RNA, 1701 nt, Artificial Sequence; identical to SEQ ID NO: 63677
  derived and/or modified sequence opt1 from hemagglutinin__InfluenzaA__ADO12153

SEQ ID NO: 67073 - RNA, 1701 nt, Artificial Sequence; identical to SEQ ID NO: 63677
  derived and/or modified sequence opt1 from hemagglutinin__InfluenzaA__ADO12163

SEQ ID NO: 67074 - RNA, 1701 nt, Artificial Sequence; identical to SEQ ID NO: 63677
  derived and/or modified sequence opt1 from hemagglutinin__InfluenzaA__ADO12173

SEQ ID NO: 67075 - RNA, 1701 nt, Artificial Sequence; identical to SEQ ID NO: 63677
  derived and/or modified sequence opt1 from hemagglutinin__InfluenzaA__ADO12183

SEQ ID NO: 67076 - RNA, 1701 nt, Artificial Sequence; identical to SEQ ID NO: 63677
  derived and/or modified sequence opt1 from hemagglutinin__InfluenzaA__ADO12193

SEQ ID NO: 67077 - RNA, 1701 nt, Artificial Sequence; identical to SEQ ID NO: 63677
  derived and/or modified sequence opt1 from hemagglutinin__InfluenzaA__ADO12203

SEQ ID NO: 67078 - RNA, 1701 nt, Artificial Sequence; identical to SEQ ID NO: 63677
  derived and/or modified sequence opt1 from hemagglutinin__InfluenzaA__ADO12213

SEQ ID NO: 67079 - RNA, 1701 nt, Artificial Sequence; identical to SEQ ID NO: 63677
  derived and/or modified sequence opt1 from hemagglutinin__InfluenzaA__ADO12223

SEQ ID NO: 67080 - RNA, 1701 nt, Artificial Sequence; identical to SEQ ID NO: 63677
  derived and/or modified sequence opt1 from hemagglutinin__InfluenzaA__ADO12233

SEQ ID NO: 67081 - RNA, 1701 nt, Artificial Sequence; identical to SEQ ID NO: 63677
  derived and/or modified sequence opt1 from hemagglutinin__InfluenzaA__ADO12243

SEQ ID NO: 67082 - RNA, 1701 nt, Artificial Sequence; identical to SEQ ID NO: 63677
  derived and/or modified sequence opt1 from hemagglutinin__InfluenzaA__ADO12253

SEQ ID NO: 67083 - RNA, 1701 nt, Artificial Sequence; identical to SEQ ID NO: 63677
  derived and/or modified sequence opt1 from hemagglutinin__InfluenzaA__ADO12263

SEQ ID NO: 67084 - RNA, 1701 nt, Artificial Sequence; identical to SEQ ID NO: 63677
  derived and/or modified sequence opt1 from hemagglutinin__InfluenzaA__ADO12273

SEQ ID NO: 67085 - RNA, 1701 nt, Artificial Sequence; identical to SEQ ID NO: 63677
  derived and/or modified sequence opt1 from hemagglutinin__InfluenzaA__ADO12283

SEQ ID NO: 67086 - RNA, 1701 nt, Artificial Sequence; identical to SEQ ID NO: 63677
  derived and/or modified sequence opt1 from hemagglutinin__InfluenzaA__ADO12293

SEQ ID NO: 67087 - RNA, 1701 nt, Artificial Sequence; identical to SEQ ID NO: 63677
  derived and/or modified sequence opt1 from hemagglutinin__InfluenzaA__ADO12303

SEQ ID NO: 67088 - RNA, 1701 nt, Artificial Sequence; identical to SEQ ID NO: 63677
  derived and/or modified sequence opt1 from hemagglutinin__InfluenzaA__ADO12313

SEQ ID NO: 67089 - RNA, 1701 nt, Artificial Sequence; identical to SEQ ID NO: 63677
  derived and/or modified sequence opt1 from hemagglutinin__InfluenzaA__ADO12323

SEQ ID NO: 67090 - RNA, 1701 nt, Artificial Sequence; identical to SEQ ID NO: 63677
  derived and/or modified sequence opt1 from hemagglutinin__InfluenzaA__ADO12333

SEQ ID NO: 67091 - RNA, 1701 nt, Artificial Sequence; identical to SEQ ID NO: 63677
  derived and/or modified sequence opt1 from hemagglutinin__InfluenzaA__ADO12343

SEQ ID NO: 67092 - RNA, 1701 nt, Artificial Sequence; identical to SEQ ID NO: 63677
  derived and/or modified sequence opt1 from hemagglutinin__InfluenzaA__ADO12353

SEQ ID NO: 67093 - RNA, 1701 nt, Artificial Sequence; identical to SEQ ID NO: 63677
  derived and/or modified sequence opt1 from hemagglutinin__InfluenzaA__ADO12363

SEQ ID NO: 67094 - RNA, 1701 nt, Artificial Sequence
  derived and/or modified sequence opt1 from hemagglutinin__InfluenzaA__ADO12373
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacaacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67095 - RNA, 1701 nt, Artificial Sequence; identical to SEQ ID NO: 65162
  derived and/or modified sequence opt1 from hemagglutinin__InfluenzaA__ADO12383

SEQ ID NO: 67096 - RNA, 1701 nt, Artificial Sequence
  derived and/or modified sequence opt1 from hemagglutinin__InfluenzaA__ADO12403
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 67097 - RNA, 1701 nt, Artificial Sequence; identical to SEQ ID NO: 65313
  derived and/or modified sequence opt1 from hemagglutinin__InfluenzaA__ADO12413

SEQ ID NO: 67098 - RNA, 1701 nt, Artificial Sequence; identical to SEQ ID NO: 63677
  derived and/or modified sequence opt1 from hemagglutinin__InfluenzaA__ADO12423

SEQ ID NO: 67099 - RNA, 1701 nt, Artificial Sequence; identical to SEQ ID NO: 63677
  derived and/or modified sequence opt1 from hemagglutinin__InfluenzaA__ADO12433

SEQ ID NO: 67100 - RNA, 1701 nt, Artificial Sequence; identical to SEQ ID NO: 63677
  derived and/or modified sequence opt1 from hemagglutinin__InfluenzaA__ADO12443

SEQ ID NO: 67101 - RNA, 1701 nt, Artificial Sequence; identical to SEQ ID NO: 63677
  derived and/or modified sequence opt1 from hemagglutinin__InfluenzaA__ADO12453

SEQ ID NO: 67102 - RNA, 1701 nt, Artificial Sequence; identical to SEQ ID NO: 63677
  derived and/or modified sequence opt1 from hemagglutinin__InfluenzaA__ADO12463

SEQ ID NO: 67103 - RNA, 1701 nt, Artificial Sequence
  derived and/or modified sequence opt1 from hemagglutinin__InfluenzaA__ADO12473
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcagaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67104 - RNA, 1701 nt, Artificial Sequence; identical to SEQ ID NO: 63677
  derived and/or modified sequence opt1 from hemagglutinin__InfluenzaA__ADO12493

SEQ ID NO: 67105 - RNA, 1701 nt, Artificial Sequence
  derived and/or modified sequence opt1 from hemagglutinin__InfluenzaA__ADO12503
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucaacuucuggaugugcagcaacggcucccugcagugccggaucugcaucuga

SEQ ID NO: 67106 - RNA, 1701 nt, Artificial Sequence
  derived and/or modified sequence opt1 from hemagglutinin__InfluenzaA__ADO12513
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcgaggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 67107 - RNA, 1701 nt, Artificial Sequence; identical to SEQ ID NO: 63677
  derived and/or modified sequence opt1 from hemagglutinin__InfluenzaA__ADO12523

SEQ ID NO: 67108 - RNA, 1701 nt, Artificial Sequence
  derived and/or modified sequence opt1 from hemagglutinin__InfluenzaA__ADO12533
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcacccggcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 67109 - RNA, 1701 nt, Artificial Sequence; identical to SEQ ID NO: 63677
  derived and/or modified sequence opt1 from hemagglutinin__InfluenzaA__ADO12543

SEQ ID NO: 67110 - RNA, 1701 nt, Artificial Sequence; identical to SEQ ID NO: 63677
  derived and/or modified sequence opt1 from hemagglutinin__InfluenzaA__ADO12553

SEQ ID NO: 67111 - RNA, 1701 nt, Artificial Sequence; identical to SEQ ID NO: 63677
  derived and/or modified sequence opt1 from hemagglutinin__InfluenzaA__ADO12563

SEQ ID NO: 67112 - RNA, 1701 nt, Artificial Sequence; identical to SEQ ID NO: 63677
  derived and/or modified sequence opt1 from hemagglutinin__InfluenzaA__ADO12573

SEQ ID NO: 67113 - RNA, 1701 nt, Artificial Sequence
  derived and/or modified sequence opt1 from hemagglutinin__InfluenzaA__ADO12593
augaaggccauccuggugguccuccuguacaccuucgccaccgcgaacgccgacacgcugugcaucggcuaccacgccaacaacagcaccgacaucguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67114 - RNA, 1701 nt, Artificial Sequence; identical to SEQ ID NO: 63677
  derived and/or modified sequence opt1 from hemagglutinin__InfluenzaA__ADO12603

SEQ ID NO: 67115 - RNA, 1701 nt, Artificial Sequence; identical to SEQ ID NO: 63677
  derived and/or modified sequence opt1 from hemagglutinin__InfluenzaA__ADO12613

SEQ ID NO: 67116 - RNA, 1701 nt, Artificial Sequence; identical to SEQ ID NO: 63677
  derived and/or modified sequence opt1 from hemagglutinin__InfluenzaA__ADO12623

SEQ ID NO: 67117 - RNA, 1701 nt, Artificial Sequence
  derived and/or modified sequence opt1 from hemagglutinin__InfluenzaA__ADO14349
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaaggggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaagggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67118 - RNA, 1701 nt, Artificial Sequence; identical to SEQ ID NO: 65941
  derived and/or modified sequence opt1 from hemagglutinin__InfluenzaA__ADO14351

SEQ ID NO: 67119 - RNA, 1701 nt, Artificial Sequence
  derived and/or modified sequence opt1 from hemagglutinin__InfluenzaA__ADO14353
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccgaggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacgggagccugcagugccggaucugcaucuga

SEQ ID NO: 67120 - RNA, 1701 nt, Artificial Sequence
  derived and/or modified sequence opt1 from hemagglutinin__InfluenzaA__ADO14354
augaaggccauccuggugguccuccuguacaccuucgccaccgcgaacgccgacacgcugugcaugggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67121 - RNA, 1701 nt, Artificial Sequence
  derived and/or modified sequence opt1 from hemagglutinin__InfluenzaA__ADO14356
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacaucccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccgaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 67122 - RNA, 1701 nt, Artificial Sequence; identical to SEQ ID NO: 65941
  derived and/or modified sequence opt1 from hemagglutinin__InfluenzaA__ADO14357

SEQ ID NO: 67123 - RNA, 1701 nt, Artificial Sequence
  derived and/or modified sequence opt1 from hemagglutinin__InfluenzaA__ADO14359
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccacccgcccaccagcgccgaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 67124 - RNA, 1701 nt, Artificial Sequence
  derived and/or modified sequence opt1 from hemagglutinin__InfluenzaA__ADO14361
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaagggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67125 - RNA, 1701 nt, Artificial Sequence
  derived and/or modified sequence opt1 from hemagglutinin__InfluenzaA__ADO14362
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaacuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67126 - RNA, 1683 nt, Artificial Sequence
  derived and/or modified sequence opt1 from hemagglutinin__InfluenzaA__ADO21015
auggagguggucagccugaucaccauccuccugcuggugaccguguccaacgccgacaagaucugcaucggcuaccagagcacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugcgaccugcuccucgggggccgcgagugguccuacaucgucgagcggcccagcgccgugaacggccugugcuaccccgggaacguggagaaccuggaggagcugcgcucccuguucagcuccgccagcuccuaccagcggauccagaucuucccgggcaccaucuggaacgucagcuacgggggcaccuccaaggccugcagcgacuccuucuacaagagcaugcgcuggcucacccagaagaacaacgcguaccccauccaggacgcccaguacacgaacaaccgggggaagaacauccuguucauguggggcaucaaccacccgcccaccgacaccacccagacgaaccuguacacccgcaccgacaccacgaccuccguggccaccgaggacaucaaccggaccuucaagccccucaucggcccccgcccccuggugaacgggcagcagggccggaucgacuacuacuggagcguccugaagcccgggcagacgcuccgcgugcgguccaacggcaaccugaucgccccgugguacggccacauccugagcggggagagccacggccgcauccucaagaccgaccugaacuccgggaacugcgugguccagugccagaccgagcggggcgggcugaacaccacgcuccccuuccacaacgugagcaaguacgcguucggcaacugccccaaguacgugggcgucaagucccugaagcuggccguggggcuccgcaacgugcccgcccggagcucccgcggccuguucggggccaucgccggcuucaucgagggcggguggagcggccuggucgcggggugguacggcuuccagcacuccaacgaccagggggugggcauggccgccgaccgggacagcacccagaaggccaucgacaagaucaccuccaaggugaacaacaucgucgacaagaugaacaagcaguacgagaucaucgaccacgaguucagcgagguggagacccgccucaacaugaucaacaacaagaucgacgaccagauccaggacaucugggccuacaacgcggagcugcugguccuccuggagaaccagaagacgcuggacgagcacgacgccaacgugaacaaccucuacaacaaggugaagcgggcccugggguccaacgccgucgaggacggcaagggcugcuucgagcuguaccacaagugcgacgaccagugcauggagaccauccgcaacgggaccuacaaccggcgcaaguacaaggaggagagccgccucgagcggcagaagaucgagggcgugaagcuggaguccgaggggaccuacaagauccugacgaucuacagcaccguggccuccagccucgucaucgcgaugggcuucgccgccuuccuguucugggccauguccaacggcagcugccgcugcaacaucugcaucuga

SEQ ID NO: 67127 - RNA, 1683 nt, Artificial Sequence
  derived and/or modified sequence opt1 from hemagglutinin__InfluenzaA__ADO21026
auggagguggucagccugaucaccauccuccugcuggugaccguguccaacgccgacaagaucugcaucggcuaccagagcacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugcgaccugcuccucgggggccgcgagugguccuacaucgucgagcggcccagcgccgugaacggccugugcuaccccgggaacguggagaaccuggaggagcugcgcucccuguucagcuccgccagcuccuaccagcggauccagaucuucccgggcaccaucuggaacgucagcuacgggggcaccuccaaggccugcagcgacuccuucuacaagagcaugcgcuggcucacccagaagaacaacgcguaccccauccaggacgcccaguacacgaacaaccgggggaagaacauccuguucauguggggcaucaaccacccgcccaccgacaccacccagacgaaccuguacacccgcaccgacaccacgaccuccguggccaccgaggacaucaaccggaccuucaacccccucaucggcccccgcccccuggugaacgggcagcagggccggaucgacuacuacuggagcguccugaagcccgggcagacgcuccgcgugcgguccaacggcaaccugaucgccccgugguacggccacauccugagcggggagagccacggccgcauccucaagaccgaccugaacuccgggaacugcgugguccagugccagaccgagcggggcgggcugaacaccacgcuccccuuccacaacgugagcaaguacgcguucggcaacugccccaaguacgugggcgucaagucccugaagcuggccguggggcuccgcaacgugcccgcccggagcucccgcggccuguucggggccaucgccggcuucaucgagggcggguggagcggccuggucgcggggugguacggcuuccagcacuccaacgaccagggggugggcauggccgccgaccgggacagcacccagaaggccaucgacaagaucaccuccaaggugaacaacaucgucgacaagaugaacaagcaguacgagaucaucgaccacgaguucagcgagguggagacccgccucaacaucaucaacaacaagaucgacgaccagauccaggacaucugggccuacaacgcggagcugcugguccuccuggagaaccagaagacgcuggacgagcacgacgccaacgugaacaaccucuacaacaaggugaagcgggcccugggguccaacgccgucgaggacggcaagggcugcuucgagcuguaccacaagugcgacgaccagugcauggagaccauccgcaacgggaccuacaaccggcgcaaguacaaggaggagagccgccucgagcggcagaagaucgagggcgugaagcuggaguccgaggggaccuacaagauccugacgaucuacagcaccguggccuccagccucgucaucgcgaugggcuucgccgccuuccuguucugggccauguccaacggcagcugccgcugcaacaucugcaucuga

SEQ ID NO: 67128 - RNA, 1683 nt, Artificial Sequence
  derived and/or modified sequence opt1 from hemagglutinin__InfluenzaA__ADO21037
auggagguggucagccugaucaccauccuccugcuggugaccguguccaacgccgacaagaucugcaucggcuaccagagcacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugcgaccugcuccucgggggccgcgagugguccuacaucgucgagcggcccagcgccgugaacggccugugcuaccccgggaacguggagaaccuggaggagcugcgcucccuguucagcuccgccagcuccuaccagcggauccagaucuucccgggcaccaucuggaacgucagcuacgggggcaccuccaaggccugcagcgacuccuucuacaagagcaugcgcuggcucacccagaagaacaacgcguaccccauccaggacgcccaguacacgaacaaccgggggaagaacauccuguucauguggggcaucaaccacccgcccaccgacaccacccagacgaaccuguacacccgcaccgacaccacgaccuccguggccaccgaggacaucaaccggaccuucaagcccuacaucggcccccgcccccucgugaacgggcagcagggccggaucgacuacuacuggagcguccugaagcccgggcagacgcugcgcgugcgguccaacggcaaccucaucgccccgugguacggccacauccugagcggggagagccacggccgcauccugaagaccgaccucaacuccgggaacugcgugguccagugccagaccgagcggggcgggcugaacaccacgcugcccuuccacaacgugagcaaguacgcguucggcaacugccccaaguacgugggcgucaagucccucaagcuggccguggggcugcgcaacgugcccgcccggagcucccgcggccucuucggggccaucgccggcuucaucgagggcggguggagcggccuggucgcggggugguacggcuuccagcacuccaacgaccagggggugggcauggccgccgaccgggaccugacccagaaggccaucgacaagaucaccagcaaggugaacaacaucgucgacaagaugaacaagcaguacgagaucaucgaccacgaguucuccgagguggagacccgccucaacaugaucaacaacaagaucgacgaccagauccaggacaucugggccuacaacgcggagcugcugguccuccuggagaaccagaagacgcuggacgagcacgacgccaacgugaacaaccucuacaacaaggugaagcgggcccuggggagcaacgccgucgaggacggcaagggcugcuucgagcuguaccacaagugcgacgaccagugcauggagaccauccgcaacgggaccuacaaccggcgcaaguacaaggaggagucccgccucgagcggcagaagaucgagggcgugaagcuggagagcgaggggaccuacaagauccugacgaucuacuccaccguggccagcucccucgucaucgcgaugggcuucgccgccuuccuguucugggccaugagcaacggcuccugccgcugcaacaucugcaucuga

SEQ ID NO: 67129 - RNA, 1683 nt, Artificial Sequence
  derived and/or modified sequence opt1 from hemagglutinin__InfluenzaA__ADO21048
auggagguggucagccugaucaccauccuccugcuggugaccguguccaacgccgacaagaucugcaucggcuaccagagcacgaacuccaccgagaccgucgacacccucacggagaacaacgugcccguggcccacgcgaaggagcugcugcacaccgagcacaacgggaugcucugcgccaccaaccugggccacccgcugauccucgacacgugcaccaucgaggggcugaucuacggcaaccccagcugcgaccugcuccucgggggccgcgagugguccuacaucgucgagcggcccagcgccgugaacggccugugcuaccccgggaacguggagaaccuggaggagcugcgcucccuguucagcuccgccagcuccuaccagcggauccagaucuucccgggcaccaucuggaacgucagcuacgggggcaccuccaaggccugcagcgacuccuucuacaagagcaugcgcuggcucacccagaagaacaacgcguaccccauccaggacgcccaguacacgaacaaccgggggaagaacauccacuucauguggggcaucaaccacccgcccaccgacaccacccagacgaaccuguacacccgcaccgacaccacgaccuccguggccaccgaggacaucaaccggaccuucaagccccugaucggcccccgcccccucgugaacgggcagcagggccggaucgacuacuacuggagcguccugaagcccgggcagacgcugcgcgugcgguccaacggcaaccucaucgccccgugguacggccacauccugagcggggagagccacggccgcauccugaagaccgaccucaacuccgggaacugcgugguccagugccagaccgagcggggcgggcugaacaccacgcugcccuuccacaacgugagcaaguacgcguucggcaacugccccaaguacgugggcgucaagucccucaagcuggccguggggcugcgcaacgugcccgcccggagcucccgcggccucuucggggccaucgccggcuucaucgagggcggguggagcggccuggucgcggggugguacggcuuccagcacuccaacgaccagggggugggcauggccgccgaccgggugagcacccagaaggccaucgacaagaucaccuccaaggucaacaacaucguggacaagaugaacaagcaguacgagaucaucgaccacgaguucagcgaggucgagacccgccugaacaugaucaacaacaagaucgacgaccagauccaggacaucugggccuacaacgcggagcuccuggugcugcucgagaaccagaagacgcuggacgagcacgacgccaacgugaacaaccuguacaacaaggucaagcgggcccucggguccaacgccguggaggacggcaagggcugcuucgagcuguaccacaagugcgacgaccagugcauggagaccauccgcaacgggaccuacaaccggcgcaaguacaaggaggagagccgccuggagcggcagaagaucgagggcgugaagcucgaguccgaggggaccuacaagauccugacgaucuacagcaccgucgccuccagccuggugaucgcgaugggcuucgccgccuuccucuucugggccauguccaacggcagcugccgcugcaacaucugcaucuga

SEQ ID NO: 67130 - RNA, 1701 nt, Artificial Sequence
  derived and/or modified sequence opt1 from hemagglutinin__InfluenzaA__ADO25092
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaacagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 67131 - RNA, 1701 nt, Artificial Sequence; identical to SEQ ID NO: 65549
  derived and/or modified sequence opt1 from hemagglutinin__InfluenzaA__ADO25112

SEQ ID NO: 67132 - RNA, 1701 nt, Artificial Sequence; identical to SEQ ID NO: 65549
  derived and/or modified sequence opt1 from hemagglutinin__InfluenzaA__ADO25122

SEQ ID NO: 67133 - RNA, 1701 nt, Artificial Sequence
  derived and/or modified sequence opt1 from hemagglutinin__InfluenzaA__ADO25132
augaacgccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccgacaucaucaucagcgacacgcccguccacgacugcaacacgaccugccagaccccgaagggcgccaucaacaccucccugcccuuccagaacauccaccccaucaccaucggcaagugccccaaguacgucaagagcaccaagcuccggcuggcgaccgggcugcgcaacgugccguccauccagagccggggccucuucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaagaucaacuccgugaucgagaagaugaacacccaguucacggccguggggaaggaguucaaccaccuggagaagcgcaucgagaaccugaacaagaaggucgacgacggcuuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcucaaccgggaggagaucgacggggucaagcuggagagcacccgcaucuaccagauccuggcgaucuacuccaccguggccagcagccucgugcuggucgugucccugggcgccaucagcuucuggaugugcuccaacgggagccuccagugccggaucugcaucuga

SEQ ID NO: 67134 - RNA, 1701 nt, Artificial Sequence; identical to SEQ ID NO: 65290
  derived and/or modified sequence opt1 from hemagglutinin__InfluenzaA__ADO25142

SEQ ID NO: 67135 - RNA, 1701 nt, Artificial Sequence
  derived and/or modified sequence opt1 from hemagglutinin__InfluenzaA__ADO25152
augaaggccauccuggugguccuccuguacaccuucgccgcggccaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagccuguucgagcgcuucgagaucuuccccaagacguccagcuggcccaaccacgacuccaacaagggggucaccgccgccugcccgcacgcgggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcaccagccgguacuccaagaaguucaagcccgagaucgcgauccgcccgaagguccgggaccaggagggccgcaugaacuacuacuggacgcucguggagcccggggacaagaucaccuucgaggccaccggcaaccugguggucccccgguacgccuucgccauggagcgcaacgccgggagcggcaucaucaucuccgacacccccgugcacgacugcaacacgaccugccagaccccgaagggcgcgaucaacaccagccugcccuuccagaacauccaccccaucacgaucgggaagugccccaaguacgugaaguccaccaagcuccggcuggccaccggccugcgcaacgucccgagcauccagucccggggccucuucggcgccaucgccggguucaucgagggcggcuggaccgggaugguggacggcugguacggguaccaccaccagaacgagcagggcagcggguacgccgcggaccugaaguccacgcagaacgccaucgacaagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggcgaagcucaaccgggaggagaucgacggcgugaagcuggaguccacccgcaucuaccagauccuggccaucuacagcaccgucgccuccagccucgugcugguggucagccugggggccaucuccuucuggaugugcagcaacggcucccuccagugccggaucugcaucuga

SEQ ID NO: 67136 - RNA, 1701 nt, Artificial Sequence; identical to SEQ ID NO: 65229
  derived and/or modified sequence opt1 from hemagglutinin__InfluenzaA__ADO25162

SEQ ID NO: 67137 - RNA, 1701 nt, Artificial Sequence; identical to SEQ ID NO: 65229
  derived and/or modified sequence opt1 from hemagglutinin__InfluenzaA__ADO25172

SEQ ID NO: 67138 - RNA, 1701 nt, Artificial Sequence; identical to SEQ ID NO: 65229
  derived and/or modified sequence opt1 from hemagglutinin__InfluenzaA__ADO25182

SEQ ID NO: 67139 - RNA, 1701 nt, Artificial Sequence; identical to SEQ ID NO: 63677
  derived and/or modified sequence opt1 from hemagglutinin__InfluenzaA__ADO25192

SEQ ID NO: 67140 - RNA, 1701 nt, Artificial Sequence; identical to SEQ ID NO: 63677
  derived and/or modified sequence opt1 from hemagglutinin__InfluenzaA__ADO25202

SEQ ID NO: 67141 - RNA, 1701 nt, Artificial Sequence
  derived and/or modified sequence opt1 from hemagglutinin__InfluenzaA__ADO25212
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagcggaaggaggugcugguccucuggggcauccaccaccccagcaccuccgccgaccagcagagccuguaccagaacgccgacuccuacguguucguggggacgagccgcuacuccaagaaguucaagcccgagaucgccauccggccgaagguccgcgaccaggagggccggaugaacuacuacuggacccugguggagcccggcgacaagaucaccuucgaggccaccgggaaccucguggucccccgcuacgcguucgccauggagcggaacgccggcagcgggaucaucaucuccgacacgcccgugcacgacugcaacacgaccugccagaccccggagggcgccaucaacaccagccugcccuuccagaacauccaccccaucaccaucggcaagugccccaaguacgugaaguccaccaagcugcgccucgccaccgggcugcggaacgucccgagcauccagucccgcggccuguucggggcgaucgccggcuucaucgagggcggguggacgggcaugguggacgggugguacggcuaccaccaccagaacgagcaggggagcggcuacgccgccgaccucaaguccacccagaacgccaucgacgagaucaccaacaaggugaacagcgucaucgagaagaugaacacccaguucacggcgguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggccaucuacagcaccgucgcgagcucccuggugcucguggucagccugggcgccaucuccuucuggaugugcagcaacgggucccugcagugccgcaucugcaucuga

SEQ ID NO: 67142 - RNA, 1701 nt, Artificial Sequence
  derived and/or modified sequence opt1 from hemagglutinin__InfluenzaA__ADO25222
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 67143 - RNA, 1701 nt, Artificial Sequence; identical to SEQ ID NO: 65290
  derived and/or modified sequence opt1 from hemagglutinin__InfluenzaA__ADO25232

SEQ ID NO: 67144 - RNA, 1701 nt, Artificial Sequence; identical to SEQ ID NO: 65229
  derived and/or modified sequence opt1 from hemagglutinin__InfluenzaA__ADO25242

SEQ ID NO: 67145 - RNA, 1701 nt, Artificial Sequence; identical to SEQ ID NO: 65307
  derived and/or modified sequence opt1 from hemagglutinin__InfluenzaA__ADO25252

SEQ ID NO: 67146 - RNA, 1701 nt, Artificial Sequence; identical to SEQ ID NO: 65549
  derived and/or modified sequence opt1 from hemagglutinin__InfluenzaA__ADO25262

SEQ ID NO: 67147 - RNA, 1701 nt, Artificial Sequence
  derived and/or modified sequence opt1 from hemagglutinin__InfluenzaA__ADO25272
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgugaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 67148 - RNA, 1701 nt, Artificial Sequence; identical to SEQ ID NO: 65290
  derived and/or modified sequence opt1 from hemagglutinin__InfluenzaA__ADO25282

SEQ ID NO: 67149 - RNA, 1698 nt, Artificial Sequence; identical to SEQ ID NO: 63496
  derived and/or modified sequence opt1 from hemagglutinin__InfluenzaA__ADO27622

SEQ ID NO: 67150 - RNA, 1701 nt, Artificial Sequence; identical to SEQ ID NO: 63677
  derived and/or modified sequence opt1 from hemagglutinin__InfluenzaA__ADO29887

SEQ ID NO: 67151 - RNA, 1701 nt, Artificial Sequence
  derived and/or modified sequence opt1 from hemagglutinin__InfluenzaA__ADO29888
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 67152 - RNA, 1701 nt, Artificial Sequence
  derived and/or modified sequence opt1 from hemagglutinin__InfluenzaA__ADO29889
augaaggccauccuggugguccuccuguacaccuucgccaccgcgaacgccgacauccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacgggaccugcuaccccggcgacuucaucgacuacgaggagcugcgggagcagcucuccagcguguccagcuucgagcgcuucgagaucuuccccaagacguccagcuggcccaaccacgacuccaacaagggcgucaccgccgccugcccgcacgccggcgccaagagcuucuacaagaaccugaucuggcuggugaagaaggggaacuccuaccccaagcucagcaagagcuacaucaacgacaagggcaaggaggugcugguccugugggggauccaccaccccuccaccagcgcggaccagcagucccucuaccagaacgccgacgccuacguguucgugggcaccagccgguacuccaagaaguucaagcccgagaucgccauccgcccgaagguccgggaccaggagggccgcaugaacuacuacuggacgcugguggagcccggggacaagaucaccuucgaggccaccggcaaccugguggucccccgguacgcguucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggccaccggccuccgcaacgucccgagcauccagucccgggggcuguucggcgcgaucgccggguucaucgagggcggcuggaccgggaugguggacggcugguacggguaccaccaccagaacgagcagggcagcggguacgccgccgaccugaaguccacgcagaacgccaucgacgagaucaccaacaaggugaacagcgucaucgagaagaugaacacccaguucaccgcggugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcaacggcucccugcagugccggaucugcaucuga

SEQ ID NO: 67153 - RNA, 1701 nt, Artificial Sequence
  derived and/or modified sequence opt1 from hemagglutinin__InfluenzaA__ADO29890
augaaggccauccuggugguccuccuguacaccuucgccaccgcgaaggccgacacgcugugcaucggcuaccacgccaacaacagcgccgacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacccgaacaagggcgucaccgccgccugcccccacgcgggcgccaagagcuucuacaagaaccugaucuggcucgugaagaaggggaacuccuaccccaagcugagcaaguccuacaucaacgacaagggcaaggaggugcugguccucugggggauccaccaccccagcaccagcguggaccagcagucccuguaccagaacgccgacgccuacguguucgucggcaccagccgguacuccaagaaguucaagccggagaucgccauccgccccaaggugcgggaccaggagggccgcaugaacuacuacuggacgcugguggagcccggggacaagaucaccuucgaggcgaccggcaaccucgucgugccccgguacgccuucgccauggagcgcaacgccgggagcggcaucaucaucuccgacaccccggugcacgacugcaacacgaccugccagacccccaagggcgccaucaacaccagccugcccuuccagaacauccaccccaucacgaucgggaagugcccgaaguacgucaaguccaccaagcugcggcucgcgaccggccugcgcaacgugcccagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggucaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 67154 - RNA, 1701 nt, Artificial Sequence
  derived and/or modified sequence opt1 from hemagglutinin__InfluenzaA__ADO29891
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaccaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcucagcgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 67155 - RNA, 1701 nt, Artificial Sequence
  derived and/or modified sequence opt1 from hemagglutinin__InfluenzaA__ADO29892
augaaggccauccuggugguccuccuguacaccuucgccaccgcgaaggccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggccggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcguggaccagcagucccuguaccagaacgccgacgccuacguguucgucggcacgagccgcuacuccaagaaguucaagccggagaucgccauccggcccaaggugcgcgaccaggagggccggaugaacuacuacuggacccugguggagcccggggacaagaucaccuucgaggccaccggcaaccucgucgugccccgcuacgcguucgccauggagcggaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgucaaguccaccaagcugcgccucgccaccggccugcggaacgugcccagcauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggucaacagcgugaucgagaagaugaacacccaguucacggcggucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacuccaacgucaagaaccucuacgagaaggugcggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgucaagcucgaguccacccggaucuaccagauccuggccaucuacagcaccguggcguccagccuggugcucgucgugagccugggggccaucuccuucuggaugugcagcaacggcucccugcagugccgcaucugcaucuga

SEQ ID NO: 67156 - RNA, 1701 nt, Artificial Sequence; identical to SEQ ID NO: 64475
  derived and/or modified sequence opt1 from hemagglutinin__InfluenzaA__ADO29893

SEQ ID NO: 67157 - RNA, 1701 nt, Artificial Sequence
  derived and/or modified sequence opt1 from hemagglutinin__InfluenzaA__ADO29894
augaaggccauccuggugguccuccuguacaccuucgccaccgcgaacgccgacacgcugugcaucggcuaccacgccaacaacagcaccgacaccguggacaccgugcucgagaugaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaagggguccagcuaccccaagcucagcaaguccuacaucaacgacaagggcaaggaggugcugguccugugggggauccaccaccccagcaccuccgcggaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgccaucuacagcaccgucgcguccagccuggugcugguggucucccucggggccaucagcuucuggaugugcuccaacggcagccugcagugccggaucugcaucuga

SEQ ID NO: 67158 - RNA, 1701 nt, Artificial Sequence
  derived and/or modified sequence opt1 from hemagglutinin__InfluenzaA__ADO29895
augaaggccauccugguggcccuccuguacaccuucgcgaccgccaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgcgggcuggauccuggggaacccggagugcgagagcuucuccaccagcuccagcugguccuacaucgucgagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggugaccgccgccugcccgcacgccggcgccaagagcuucuacaagaaccugaucuggcuggucaagaagggguccagcuaccccaagcucagcaaguccuacaucaacgacaagggcaaggaggugcuggugcugugggggauccaccaccccagcaccuccgccgaccagcagagccucuaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccuccccuuccagaacauccaccccaucaccaucgggaagugccccaaguacgugaagggcaccaagcugcggcuggcgaccgggcuccgcaacgugccgagcauccagucccggggccuguucggggccaucgccggcuucaucgagggcggguggacgggcauggucgacgggugguacggcuaccaccaccagaacgagcaggggagcggcuacgccgccgaccugaaguccacccagaacgcgaucgacgagaucaccaacaaggugaacagcgugaucgagaagaugaacacccaguucacggccgucggcaaggaguucaaccaccucgagaagcgcaucgagaaccugaacaagaagguggacgacggguuccuggacaucuggaccuacaacgccgagcuccugguccugcucgagaacgagcggacccuggacuaccacgacuccaacgugaagaaccuguacgagaaggugcgcagccagcucaagaacaacgccaaggagaucggcaacgggugcuucgaguucuaccacaagugcgacaacacgugcauggagcgggucaagaacggcaccuacgacuaccccaaguacuccgaggaggccaagcugaaccgcgaggagaucgacggggugaagcuggagagcacccggaucuaccagauccucgcgaucuacuccaccguggccagcagccugguccugguggugucccucggcgccaucagcuucuggaugugcuccaacggcagccugcagugccgcaucugcaucuga

SEQ ID NO: 67159 - RNA, 1701 nt, Artificial Sequence
  derived and/or modified sequence opt1 from hemagglutinin__InfluenzaA__ADO29897
augaaggccauccuggugguccuccuguacaccuucgccaccgcgaacgccgacauccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcaagugcuaccccggcgacuucaucgacuacgaggagcugcgggagcagcucuccagcguguccagcuucgagcgcuucgagaucuuccccaagaccuccagcuggcccaaccacgacuccaacaagggggucacgaccgccugcccgcacgccggcgccaagagcuucuacaagaaccugaucuggcuggugaagaaggggaacuccuacccccggcucagcaagagcuacaucaacgacaagggcaaggaggugcugguccugugggggauccaccaccccuccaccagcgccgaccagcagucccucuaccagaacgcggacgccuacguguucgugggcaccagccgcuacuccaagaaguucaagcccgagaucgccauccggccgaagguccgcgaccaggagggccggaugaacuacuacuggacgcugguggagcccggggacaagaucaccuucgaggccaccggcaaccugguggucccccgcuacgccuucgcgauggagcggaacgccgggagcggcaucaucaucuccgacacccccgugcacggcugcaacacgaccugccagaccccgaagggggccaucaacaccagccuccccuuccagaacauccaccccaucacgaucggcaagugccccaaguacgugaaguccaccaagcugcgccuggccaccgggcuccggaacgucccgagcauccagucccgcggccuguucggggccguggcgggcuucaucgagggcggguggaccggcaugguggacgggugguacggcuaccaccaccagaacgagcaggggagcggcuacgccgccgaccugaaguccacgcagaacgccaucgacgagaucaccaacaaggucaacagcgugaucgagaagaugaacacccaguucaccgccgucggcaaggaguucaaccaccucgagaagcggaucgagaaccugaacaagaagguggacgacggguuccuggacaucuggacguacaacgcggagcuccuggugcugcucgagaacgagcgcacccuggacuaccacgacuccaacgucaagaaccuguacgagaaggugcggagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggucaagcuggaguccacccggaucuaccagauccucgccaucuacagcaccguggccagcucccuggugcuggucgugagccucggcgcgaucuccuucuggaugugcagcaacggcucccugcagugccgcaucugcaucuga

SEQ ID NO: 67160 - RNA, 1701 nt, Artificial Sequence; identical to SEQ ID NO: 64475
  derived and/or modified sequence opt1 from hemagglutinin__InfluenzaA__ADO29898

SEQ ID NO: 67161 - RNA, 1701 nt, Artificial Sequence
  derived and/or modified sequence opt1 from hemagglutinin__InfluenzaA__ADO29899
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaccugcaucuga

SEQ ID NO: 67162 - RNA, 1701 nt, Artificial Sequence
  derived and/or modified sequence opt1 from hemagglutinin__InfluenzaA__ADO29900
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgaccucaucgacuacgaggagcugcgggagcagcugagcuccgugagcuccuucgagcgcuucgagaucuuccccaagaccagcuccuggcccaaccacgaccucaacaagggggucaccgccgccugcccgcacgccggcgccaagagcuucuacaagaaccugaucuggcuggugaagaaggggaacuccuaccccaagcucagcaaguccuacaucaacgacaagggcaaggaggugcugguccugugggggauccaccaccccagcaccagcgccgaccagcagucccucuaccagaacgccgacgccuacguguucgugggcacgagccgguacuccaagaaguccaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccgggagcggcaucaucaucagcgacacgcccgugcacgacugcaacacgaccugccagaccccgaagggcgccaucaacaccucccuccccuuccagaacauccaccccaucaccaucgggaagugccccaaguacgugcggagcaccaagcugcgccuggcgaccggccuccggaacgucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucugggccuacaacgccgagcuccuggugcugcucgagaacgagcgcacccuggacuaccacgacagcaacgugaagaaccuguacgagaagguccggucccagcucaagaacaacgccaaggagaucgggaacggcugcuucgaguucuaccacaagugcgacaacacgugcauggagagcgugaagaacgggaccuacgacuaccccaaguacuccgaggaggcgaagcugaaccgcgaggagaucgacggcgugaagcuggagagcacccggaucuaccagauccucgccaucuacuccaccgucgccagcagccuggugcugguggucucccucggggccaucagcuucuggaugugcuccaacggcagccugcagugccgcaucugcaucuga

SEQ ID NO: 67163 - RNA, 1701 nt, Artificial Sequence
  derived and/or modified sequence opt1 from hemagglutinin__InfluenzaA__ADO29901
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgccaagaagggcaacagcuaccccaagguguccaagagcuacaucaacgacaaggggaaggaggugcugguccuguggggcauccaccaccccagcaccuccgccgaccagcagagccucuaccagaacgccgacgccuacguguucguggggacgucccgguacagcaagaaguucaagcccgagaucgcgauccgcccgaagguccgggaccaggagggccgcaugaacuacuacuggacccugguggagcccggcgacaagaucaccuucgaggccaccgggaaccugguggucccccgguacgccuucgccauggagcgcaacgccggcuccgggaucaucaucagcgacacgcccgugcacgacugcaacacgaccugccagaccccgaagggcgcgaucaacaccucccuccccuuccagaacauccaccccaucaccaucggcaagugccccaaguacgucaagagcaccaagcugcggcuggccaccgggcuccgcaacgugccguccauccagagccggggccuguucggggccaucgccggcuucaucgagggcggguggacgggcaugguggacgggugguacggcuaccaccaccagaacgagcagggguccggcuacgccgcggaccucaagagcacccagaacgccaucgacgagaucaccaacaaggugaacuccgucaucgagaagaugaacacccaguucacggccguggggaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcuggagagcacccgcaucuaccagauccucgccaucuacuccaccgucgccagcagccuggugcugguggucucccucggcgccaucagcuucuggaugugcuucaacgggucccugcagugccggaucugcaucuga

SEQ ID NO: 67164 - RNA, 1701 nt, Artificial Sequence
  derived and/or modified sequence opt1 from hemagglutinin__InfluenzaA__ADO29902
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagggggugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 67165 - RNA, 1701 nt, Artificial Sequence
  derived and/or modified sequence opt1 from hemagglutinin__InfluenzaA__ADO29903
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaccgccggcuggauccuggggaacccggagugcgagagccuguccaccgcgagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacccgaacaagggcgucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcacgagcgccgaccagcagucccuguaccagaacgccgacgccuacguguucgugggcaccagccgguacuccaagaaguucaagccggagaucgccauccgccccaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgcgacgggccugcgcaacguccccagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 67166 - RNA, 1701 nt, Artificial Sequence
  derived and/or modified sequence opt1 from hemagglutinin__InfluenzaA__ADO29904
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccgccccagcaccagcgccgaccagcagucccuguaccagaacgccgacgccuacguguucgugggcacgagccgguacuccaagaaguucaagccggagaucgccauccgccccaaggucggcgaccaggaggggcggaugaacuacuacuggacccugguggagcccggcgacaagaucaccuucgaggcgaccgggaaccucguggucccccgcuacgccuucgccauggagcggaacgccggcagcggcaucaucaucuccaacacgccggugcacgacugcaacacgaccugccagacccccaagggggccaucaacaccagccugcccuuccagaacauccaccccaucaccaucggcaagugcccgaaguacgugaaguccaccaagcugcgccucgcgaccgggcugcggaacguccccagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccuccagccuggugcucguggucagccugggcgccaucuccuucuggaugugcagcaacggcucccugcagugccgcaucugcaucuga

SEQ ID NO: 67167 - RNA, 1701 nt, Artificial Sequence
  derived and/or modified sequence opt1 from hemagglutinin__InfluenzaA__ADO29905
augaaggccauccuggugguccuccuguacaccuucgccaccgcgaacgccgacacgcugugcaucggcuaccacgccaacaacagcaccgacaccguggacaccgugcucgagaagaacgucacggugacccgcuccgugaaccugcuggaggacaagcacaacgggaagcucugcaagcugcggggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccaacacgccggugcacgacugcaacacgaccugccagacccccaagggcgccaucaacaccagccugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 67168 - RNA, 1701 nt, Artificial Sequence
  derived and/or modified sequence opt1 from hemagglutinin__InfluenzaA__ADO29906
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagagccuguccaccgcgagcuccuggagcuacaucguggagaccuccagcuccgacaacgggacgugcuaccccggcgacuucaucgacuacgaggagcuccgggagcagcugagcuccgugagcuccuucgagcgguucgagaucuuccccaagaccagcuccuggcccaaccacgacccgaacaagggcgucaccgccgccugcccccacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucguggggacgagccgcuacuccaagaaguucaagccggagaucgccauccggcccaagguccgcgaccaggagggccggaugaacuacuacuggacccugguggagcccggcgacaagaucaccuucgaggcgaccgggaaccucguggucccccgcuacgccuucgccauggagcggaacgccggcagcgggaucaucaucuccgacacgccggugcacgacugcaacacgaccugccagacccccaagggcgccaucaacaccagccugcccuuccagaacauccaccccaucaccaucggcaagugcccgaaguacgugaaguccaccaagcugcgccucgcgaccgggcugcggaacguccccagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccuccagccuggugcucguggucagccugggcgccaucuccuucuggaugugcagcaacgggucccugcagugccgcaucugcaucuga

SEQ ID NO: 67169 - RNA, 1701 nt, Artificial Sequence
  derived and/or modified sequence opt1 from hemagglutinin__InfluenzaA__ADO29907
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaagcugaagccggagaucgccauccgccccaagguccgggaccaggagggccgcaugaacuaccacuggacccucguggagcccggggacaagaucaccuucgaggcgaccggcaaccugguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcuccggcuggcgaccggccugcgcaacguccccagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 67170 - RNA, 1701 nt, Artificial Sequence
  derived and/or modified sequence opt1 from hemagglutinin__InfluenzaA__ADO29908
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggaguggcgcaugaacuacuacuggacccugguggagcccggcgacaagaucaccuucgaggcgaccgggaaccucguggucccccgguacgccuucgccauggagcgcaacgccggcagcgggaucaucaucuccgacacgccggugcacgacugcaacacgaccugccagacccccaagggcgccaucaacaccagccugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcgucuaccagauccuggcgaccuacagcaccguggccuccagccuggugcucgucgugagccugggcgccaucuccuucuggaugugcagcaacgggucccugcagugccggaucugcaucuga

SEQ ID NO: 67171 - RNA, 1701 nt, Artificial Sequence
  derived and/or modified sequence opt1 from hemagglutinin__InfluenzaA__ADO29909
augaaggccauccuggugguccuccuguacaccuucgccaccgcgaacgccgacacgcugcgcaucggcuaccacgccaacaacagcaccgacaccguggacaccgugcucgagaagaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcagcggguacgccgccgaccucaaguccauccagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccugauccucguggugagccugggggccaucuccuucuggaugugcagcaacggcucccugcagugccgcaucugcaucuga

SEQ ID NO: 67172 - RNA, 1701 nt, Artificial Sequence
  derived and/or modified sequence opt1 from hemagglutinin__InfluenzaA__ADO29910
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagccccgcggcgucgccccgcugcaccuggggaagugcaacaucgccggcuggauccucgggaaccccgagugcgagagccuguccaccgcgagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggccgaaccacgaccccaacaagggggucaccgccgccugcccccacgccggcgccaagagcuucuacaagaaccugaucuggcuggugaagaaggggaacuccuaccccaagcucagcaaguccuacaucaacgacaagggcaaggaggugcugguccugugggggauccaccacccgagcaccagcgcggaccagcagucccucuaccagaacgccgacgccuacguguucgugggcacgagccgguacuccaagaaguucaagcccgagaucgccauccgccccaagguccgggaccaggagggccgcaugaacuacuacuggacccugguggagcccggggacaagaucaccuucgaggcgaucggcaaccugguggucccgcgguacgccuucgccauggagcgcaacgccgggagcggcaucaucaucuccgacacccccgugcacgacugcaacacgaccugccagacccccaagggcgccaucaacaccagccuccccuuccagaacauccacccgaucacgaucgggaagugccccaaguacgugaaguccaccaagcugcggcuggcgaccggccuccgcaacguccccagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccggggcgagaucgacggggugaagcuggaguccacccgcaucuaccagauccucgcgaucuacagcaccgucgccuccagccuggugcugguggucagccucggcgccaucuccuucuggaugugcagcaacggcucccugcagugccggaucugcaucuga

SEQ ID NO: 67173 - RNA, 1701 nt, Artificial Sequence; identical to SEQ ID NO: 65399
  derived and/or modified sequence opt1 from hemagglutinin__InfluenzaA__ADO30407

SEQ ID NO: 67174 - RNA, 1701 nt, Artificial Sequence; identical to SEQ ID NO: 65290
  derived and/or modified sequence opt1 from hemagglutinin__InfluenzaA__ADO30417

SEQ ID NO: 67175 - RNA, 1701 nt, Artificial Sequence; identical to SEQ ID NO: 65012
  derived and/or modified sequence opt1 from hemagglutinin__InfluenzaA__ADO33202

SEQ ID NO: 67176 - RNA, 1701 nt, Artificial Sequence; identical to SEQ ID NO: 64520
  derived and/or modified sequence opt1 from hemagglutinin__InfluenzaA__ADO33240

SEQ ID NO: 67177 - RNA, 1701 nt, Artificial Sequence; identical to SEQ ID NO: 63677
  derived and/or modified sequence opt1 from hemagglutinin__InfluenzaA__ADO33247

SEQ ID NO: 67178 - RNA, 1701 nt, Artificial Sequence; identical to SEQ ID NO: 64520
  derived and/or modified sequence opt1 from hemagglutinin__InfluenzaA__ADO33254

SEQ ID NO: 67179 - RNA, 1701 nt, Artificial Sequence; identical to SEQ ID NO: 64520
  derived and/or modified sequence opt1 from hemagglutinin__InfluenzaA__ADO33261

SEQ ID NO: 67180 - RNA, 1701 nt, Artificial Sequence; identical to SEQ ID NO: 64520
  derived and/or modified sequence opt1 from hemagglutinin__InfluenzaA__ADO33269

SEQ ID NO: 67181 - RNA, 1701 nt, Artificial Sequence; identical to SEQ ID NO: 65012
  derived and/or modified sequence opt1 from hemagglutinin__InfluenzaA__ADO33277

SEQ ID NO: 67182 - RNA, 1701 nt, Artificial Sequence; identical to SEQ ID NO: 64520
  derived and/or modified sequence opt1 from hemagglutinin__InfluenzaA__ADO33285

SEQ ID NO: 67183 - RNA, 1701 nt, Artificial Sequence; identical to SEQ ID NO: 65012
  derived and/or modified sequence opt1 from hemagglutinin__InfluenzaA__ADO33293

SEQ ID NO: 67184 - RNA, 1701 nt, Artificial Sequence; identical to SEQ ID NO: 65012
  derived and/or modified sequence opt1 from hemagglutinin__InfluenzaA__ADO33307

SEQ ID NO: 67185 - RNA, 1701 nt, Artificial Sequence; identical to SEQ ID NO: 64520
  derived and/or modified sequence opt1 from hemagglutinin__InfluenzaA__ADO33313

SEQ ID NO: 67186 - RNA, 1701 nt, Artificial Sequence; identical to SEQ ID NO: 66770
  derived and/or modified sequence opt1 from hemagglutinin__InfluenzaA__ADO33329

SEQ ID NO: 67187 - RNA, 1701 nt, Artificial Sequence; identical to SEQ ID NO: 64520
  derived and/or modified sequence opt1 from hemagglutinin__InfluenzaA__ADO33337

SEQ ID NO: 67188 - RNA, 1701 nt, Artificial Sequence; identical to SEQ ID NO: 64520
  derived and/or modified sequence opt1 from hemagglutinin__InfluenzaA__ADO33345

SEQ ID NO: 67189 - RNA, 1701 nt, Artificial Sequence; identical to SEQ ID NO: 65012
  derived and/or modified sequence opt1 from hemagglutinin__InfluenzaA__ADO33352

SEQ ID NO: 67190 - RNA, 1701 nt, Artificial Sequence; identical to SEQ ID NO: 63677
  derived and/or modified sequence opt1 from hemagglutinin__InfluenzaA__ADO33360

SEQ ID NO: 67191 - RNA, 1701 nt, Artificial Sequence; identical to SEQ ID NO: 64520
  derived and/or modified sequence opt1 from hemagglutinin__InfluenzaA__ADO33368

SEQ ID NO: 67192 - RNA, 1701 nt, Artificial Sequence; identical to SEQ ID NO: 64520
  derived and/or modified sequence opt1 from hemagglutinin__InfluenzaA__ADO33376

SEQ ID NO: 67193 - RNA, 1701 nt, Artificial Sequence; identical to SEQ ID NO: 63664
  derived and/or modified sequence opt1 from hemagglutinin__InfluenzaA__ADO33384

SEQ ID NO: 67194 - RNA, 1701 nt, Artificial Sequence; identical to SEQ ID NO: 63677
  derived and/or modified sequence opt1 from hemagglutinin__InfluenzaA__ADO33391

SEQ ID NO: 67195 - RNA, 1701 nt, Artificial Sequence
  derived and/or modified sequence opt1 from hemagglutinin__InfluenzaA__ADO79917
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 67196 - RNA, 1701 nt, Artificial Sequence
  derived and/or modified sequence opt1 from hemagglutinin__InfluenzaA__ADO79923
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcacggacaaguggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcacgagcgccgaccagcagucccuguaccagaacgccgacgccuacguguucguggggaccagccgguacuccaagaaguucaagcccgagaucgccauccgcccgaagguccgggaccaggagcgccggaugaacuacuacuggacccuggugcagcccggcgacaagaucaccuuccaggcgacgggcaaccucguggucccccgcuacgccuucgccauggagcggaacgccgggagcggcaucaucaucuccgacacccccgugcacaacugcaacacgaccugccagaccccgaagggggccaucaacaccagccugcccuuccagaacauccaccccaucaccaucggcaagugccccaaguacgugaaguccaccaagcugcgccucgcgacgggccugcggaacgucccgagcauccagucccgcgggcuguucggcgccaucgccggguucaucgagggcggguggaccggcaugguggacggcugguacggguaccaccaccagaacgagcagggcagcggguacgccgccgaccucaaguccacccagaacgcgaucgacgagaucaccaacaaggugaacagcgucaucgagaagaugaacacgcaguucaccgccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 67197 - RNA, 1701 nt, Artificial Sequence
  derived and/or modified sequence opt1 from hemagglutinin__InfluenzaA__ADO79924
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcacggacaaguggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcacgagcgccgaccagcagucccuguaccagaacgccgacgccuacguguucguggggaccagccgguacuccaagaaguucaagcccgagaucgccauccgcccgaagguccgggaccgcgagggccggaugaacuacuacuggacccugaucgagcccggcgacaagaucaccuucgagcccacggggaaccucguggugccccgcuacgcguucgccauggagcggaacgccggcagcgggaucaucaucuccgacaccccgguccacaacugcaacacgaccugccagacccccaagggcgccaucaacaccagccugcccuuccagaacauccaccccaucaccaucggcaagugcccgaaguacgugaaguccaccaagcugcgccucgccacggggcugcggaacgugcccagcauccagucccgcggccuguucggggcgaucgccggcuucaucgagggcggguggaccggcauggucgacgggugguacggcuaccaccaccagaacgagcaggggagcggcuacgccgccgaccucaaguccacccagaacgccaucgacgagaucaccaacaaggugaacagcgugaucgagaagaugaacacgcaguucaccgcggucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgaggagaucgacggggugaagcucgaguccacccggaucuaccagauccuggccaucuacagcaccguggcguccagccugguccucguggugagccugggcgccaucuccuucuggaugugcagcaacgggucccugcagugccgcaucugcaucuga

SEQ ID NO: 67198 - RNA, 1701 nt, Artificial Sequence
  derived and/or modified sequence opt1 from hemagglutinin__InfluenzaA__ADO79925
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcacgcacgaguggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcacgagcgccgaccagcagucccuguaccagaacgccgacgccuacguguucguggggaccagccgguacuccaagaaguucaagcccgagaucgccauccgcccgaagguccgggaccgcgagggccggaugaacuacuacuggacccugguggagcccggcgacaagaucaccuucgaggcgcccgggaaccucguggucccccgcuacgccuucgccauggagcggaacgccggcagcgggaucaucaucuccgacacgccggugcacaacugcaacacgaccugccagacccccaagggcgccaucaacaccagccugcccuuccagaacauccaccccaucaagaucggcaagugcuccaaguacgucaagagcaccaagcugcgccucgcgaccgggcugcggaacgugccguccauccagagccgcggccuguucggggccaucgccggcuucaucgagggcggguggaccggcaugguggacgggugguacggcuaccaccaccagaacgagcagggguccggcuacgccgccgaccucaagagcacgcagaacgcgaucgacgagaucaccaacaaggugaacuccgucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacgggagccugcagugccgcaucugcaucuga

SEQ ID NO: 67199 - RNA, 1701 nt, Artificial Sequence
  derived and/or modified sequence opt1 from hemagglutinin__InfluenzaA__ADO79926
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcacggacaaguggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuucagcaagcuguccaagacguaccugaacgacaaggggaaggaggugcucguccuguggggcauccaccaccccagcaccagcgccgaccagcagucccuguaccagaacgccgacgccuacguguucguggggaccagccgguacuccaagaaguucaagcccgagaucgccauccgccccaagguccgggaccaggagggccgcaugaacuacuacuggacccucguggagccgggcgacaagaucacguucgaggcgaccgggaaccugguggucccccgguacgccuucgccauggagcgcaacgugggcagcgggaucaucaucuccgacacccccgugcacgacugcaacaccacgugccagacccccaagggcgccaucaacaccagccugccguuccagaacauccaccccaucaccaucggcaagugccccaaguacgucaaguccacgaagcuccggcuggccaccgggcugcgcaacgugcccagcauccagucccggggccucuucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggucaacagcgugaucgagaagaugaacacccaguucaccgcggucgggaaggaguucaaccaccuggagaagcgcaucgagaaccucaacaagaagguggacgacggcuuccuggacaucuggaccuacaacgccgagcugcucgugcugcuggagaacgagcggacgcucgacuaccacgacuccaacgucaagaaccuguacgagaaggugcgcagccagcugaagaacaacgccaaggagaugaagaacggcugcuucgaguucuaccacaagugcgacaacacgugcauggaguccgugaagaacgggaccuacgacuacccgaaguacagcgaggaggccaagcucaaccgggaggagaucgacggcgucaagcuggaguccacccgcaucuaccagauccuggccaucuacagcaccguggcguccagccucgugcuggucgugagccugggggccaucuccuucuggaugugcagcaacggcucccuccagugccggaucugcaucuga

SEQ ID NO: 67200 - RNA, 1701 nt, Artificial Sequence
  derived and/or modified sequence opt1 from hemagglutinin__InfluenzaA__ADO79927
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcacggacaaguggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccgcggccaagagcuucuacaagaaccugaucuggcucgugaagaaggggaacuccuaccccaagcugagcaaguccuacaucaacgacaagggcaaggaggugcugguccucugggggauccaccaccccagcacgagcgccgaccagcagucccuguaccagaacgccgacgccuacguguucgugggcaccagccgguacuccaagaaguucaagcccgagaucgcgauccgcccgaagguccgggaccaggaggggcgcaugaacuacuacuggacccugguggagcccggcgacaagaucaccuucgaggccacgggcaaccucguggucccccgguacgccuucgccauggagcgcaacgccgggagcggcaucaucaucuccgacacccccgugcacgacugcaacacgaccugccagaccccgaagggggcgaucaacaccagccugcccuuccagaacauccaccccaucaccaucggcaagugccccaaguacgugaaguccaccaagcugcggcucgccacgggccugcgcaacaucccgagcguccagucccgggggcuguucggcgccaucgccggguucaucgagggcggguggaccggcaugguggacggcugguacggguaccaccaccagaacgagcagggcagcggguacgccgcggaccucaaguccacccagaacgccaucgacaagaucaccaacaaggugaacagcgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaugaagaacggcugcuucgaguucuaccacaagugcgacaacacgugcauggaguccgugaagaacggcaccuacgacuaccccaaguacagcgaggaggcgaagcugaaccgggaggagaucgacggggugaagcucgaguccacccgcaucuaccagauccuggccaucuacagcaccgucgccuccagccuggugcucguggucagccugggcgccaucuccuucuggaugugcagcaacgggucccugcagugccggaucugcaucuga

SEQ ID NO: 67201 - RNA, 1701 nt, Artificial Sequence
  derived and/or modified sequence opt1 from hemagglutinin__InfluenzaA__ADO79928
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcacggacaaguggaccugcuaccccggcgacuucaucgacuacgaggagcuccgggagcagcuguccagcguguccagcuucgagcgcuucgagaucuuccccaagaccaacuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccuccacgagcgccgaccagcagagccuguaccagaacgccgacgccuacguguucguggggaccuccaaguacagcaagaaguucaagcccgagaucgccauccggccgaagguccgcgaccaggagggccggaugaacuacuacuggacccugguggagcccggcgacaagaucaccuucgaggcgacggggaaccucguggucccccgcuacgccuucgccauggagcggaacgccggcuccgggaucaucaucagcgacacccccgugcacgacugcaacacgaccugccagaccccgaagggcgccaucaacaccucccugcccuuccagaacauccaccccaucaccaucggcaagugccccaaguacgucaagagcaccaagcugcgccucgcgacggggcugcggaacgugccguccauccagagccgcggccuguucggggccaucgccggcuucaucgagggcggguggaccggcaugguggacgggugguacggcuaccaccaccagaacgagcagggguccggcuacgccgccgaccucaagagcacccagaacgcgaucgacgagaucaccaacaaggugaacuccgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcucccuggugcucguggucagccugggcgccaucagcuucuggaugugcuccaacgggagccugcagugccgcaucugcaucuga

SEQ ID NO: 67202 - RNA, 1701 nt, Artificial Sequence
  derived and/or modified sequence opt1 from hemagglutinin__InfluenzaA__ADO79929
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcacggacaaguggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcacgagcgccgaccagcagucccuguaccagaacgccgacgccuacguguucguggggaccagccgguacuccaagaaguucaagcccgagaucgccauccgcccgaagguccggggccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 67203 - RNA, 1701 nt, Artificial Sequence
  derived and/or modified sequence opt1 from hemagglutinin__InfluenzaA__ADO79930
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcacggacaaguggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcacgagcgccgaccagcagucccuguaccagaacgccgacgccuacguguucguggggaccagccgguacuccaagaaguucaagcccgagaucgccauccgcccgaagguccgggaccgcgagggccggaugaacuacuacuggacccugguggagcccggcgacaagaucaccuucgaggcgacggggaaccucguggucccccgcuacgccuucgccauggagcggaacgccggcagcgggaucaucaucuccgacacccccgugcacaacugcaacacgaccugccagaccccgaagggcgccaucaacaccagccugcccuuccagaacauccaccccaucaccaucggcaagugccccaaguacgugaaguccaccaagcugcgccucgcgacggggcugcggaacgucccgagcauccagucccgcggccuguucggggccaucgccggcuucaucgagggcggguggaccggcaugguggacgggugguacggcuaccaccaccagaacgagcaggggagcggcuacgccgccgaccucaaguccacccagaacgcgaucgacgagaucaccaacaaggugaacagcgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccuccagccuggugcucguggucagccugggcgccaucuccuucuggaugugcagcaacgggucccugcagugccgcaucugcaucuga

SEQ ID NO: 67204 - RNA, 1701 nt, Artificial Sequence
  derived and/or modified sequence opt1 from hemagglutinin__InfluenzaA__ADO84715
augaaggccauccuggugguccuccuguacaccuucgccaccgcgaacgccggcacgcugugcaucggguaccacgccaacaacagcaccgacaccguggacaccgugcucgagaagaacgucacggugacccacuccgugaaccugcuggaggacaagcacaacggcaagcucugcaagcugcgcggggucgcgccccugcaccucggcaagugcaacaucgccggguggauccugggcaacccggagugcgagagccuguccaccgcgagcuccuggagcuacaucguggagaccuucuccagcgacaacggcacgugcuaccccggggacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 67205 - RNA, 1701 nt, Artificial Sequence; identical to SEQ ID NO: 63857
  derived and/or modified sequence opt1 from hemagglutinin__InfluenzaA__ADP95341

SEQ ID NO: 67206 - RNA, 1701 nt, Artificial Sequence; identical to SEQ ID NO: 63664
  derived and/or modified sequence opt1 from hemagglutinin__InfluenzaA__ADP95351

SEQ ID NO: 67207 - RNA, 1701 nt, Artificial Sequence; identical to SEQ ID NO: 63664
  derived and/or modified sequence opt1 from hemagglutinin__InfluenzaA__ADP95361

SEQ ID NO: 67208 - RNA, 1701 nt, Artificial Sequence; identical to SEQ ID NO: 63664
  derived and/or modified sequence opt1 from hemagglutinin__InfluenzaA__ADP95371

SEQ ID NO: 67209 - RNA, 1701 nt, Artificial Sequence; identical to SEQ ID NO: 63664
  derived and/or modified sequence opt1 from hemagglutinin__InfluenzaA__ADP95381

SEQ ID NO: 67210 - RNA, 1701 nt, Artificial Sequence; identical to SEQ ID NO: 63664
  derived and/or modified sequence opt1 from hemagglutinin__InfluenzaA__ADP95391

SEQ ID NO: 67211 - RNA, 1701 nt, Artificial Sequence; identical to SEQ ID NO: 63919
  derived and/or modified sequence opt1 from hemagglutinin__InfluenzaA__ADQ28007

SEQ ID NO: 67212 - RNA, 1701 nt, Artificial Sequence; identical to SEQ ID NO: 63677
  derived and/or modified sequence opt1 from hemagglutinin__InfluenzaA__ADQ28008

SEQ ID NO: 67213 - RNA, 1701 nt, Artificial Sequence; identical to SEQ ID NO: 65528
  derived and/or modified sequence opt1 from hemagglutinin__InfluenzaA__ADQ28009

SEQ ID NO: 67214 - RNA, 1701 nt, Artificial Sequence
  derived and/or modified sequence opt1 from hemagglutinin__InfluenzaA__ADQ28010
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagagccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 67215 - RNA, 1701 nt, Artificial Sequence; identical to SEQ ID NO: 63677
  derived and/or modified sequence opt1 from hemagglutinin__InfluenzaA__ADQ28011

SEQ ID NO: 67216 - RNA, 1701 nt, Artificial Sequence; identical to SEQ ID NO: 63677
  derived and/or modified sequence opt1 from hemagglutinin__InfluenzaA__ADQ28012

SEQ ID NO: 67217 - RNA, 1701 nt, Artificial Sequence; identical to SEQ ID NO: 63677
  derived and/or modified sequence opt1 from hemagglutinin__InfluenzaA__ADQ28013

SEQ ID NO: 67218 - RNA, 1701 nt, Artificial Sequence; identical to SEQ ID NO: 63919
  derived and/or modified sequence opt1 from hemagglutinin__InfluenzaA__ADQ28014

SEQ ID NO: 67219 - RNA, 1701 nt, Artificial Sequence; identical to SEQ ID NO: 63919
  derived and/or modified sequence opt1 from hemagglutinin__InfluenzaA__ADQ28015

SEQ ID NO: 67220 - RNA, 1701 nt, Artificial Sequence; identical to SEQ ID NO: 63677
  derived and/or modified sequence opt1 from hemagglutinin__InfluenzaA__ADQ28016

SEQ ID NO: 67221 - RNA, 1701 nt, Artificial Sequence; identical to SEQ ID NO: 63677
  derived and/or modified sequence opt1 from hemagglutinin__InfluenzaA__ADQ28017

SEQ ID NO: 67222 - RNA, 1701 nt, Artificial Sequence; identical to SEQ ID NO: 65923
  derived and/or modified sequence opt1 from hemagglutinin__InfluenzaA__ADQ28018

SEQ ID NO: 67223 - RNA, 1701 nt, Artificial Sequence; identical to SEQ ID NO: 63919
  derived and/or modified sequence opt1 from hemagglutinin__InfluenzaA__ADQ28019

SEQ ID NO: 67224 - RNA, 1701 nt, Artificial Sequence
  derived and/or modified sequence opt1 from hemagglutinin__InfluenzaA__ADQ28020
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 67225 - RNA, 1701 nt, Artificial Sequence; identical to SEQ ID NO: 64871
  derived and/or modified sequence opt1 from hemagglutinin__InfluenzaA__ADQ28021

SEQ ID NO: 67226 - RNA, 1701 nt, Artificial Sequence
  derived and/or modified sequence opt1 from hemagglutinin__InfluenzaA__ADQ28022
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 67227 - RNA, 1701 nt, Artificial Sequence; identical to SEQ ID NO: 63677
  derived and/or modified sequence opt1 from hemagglutinin__InfluenzaA__ADQ28023

SEQ ID NO: 67228 - RNA, 1701 nt, Artificial Sequence; identical to SEQ ID NO: 63919
  derived and/or modified sequence opt1 from hemagglutinin__InfluenzaA__ADQ28024

SEQ ID NO: 67229 - RNA, 1701 nt, Artificial Sequence; identical to SEQ ID NO: 63919
  derived and/or modified sequence opt1 from hemagglutinin__InfluenzaA__ADQ28025

SEQ ID NO: 67230 - RNA, 1701 nt, Artificial Sequence; identical to SEQ ID NO: 64422
  derived and/or modified sequence opt1 from hemagglutinin__InfluenzaA__ADQ28028

SEQ ID NO: 67231 - RNA, 1701 nt, Artificial Sequence; identical to SEQ ID NO: 65902
  derived and/or modified sequence opt1 from hemagglutinin__InfluenzaA__ADQ28029

SEQ ID NO: 67232 - RNA, 1701 nt, Artificial Sequence
  derived and/or modified sequence opt1 from hemagglutinin__InfluenzaA__ADQ28030
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67233 - RNA, 1701 nt, Artificial Sequence; identical to SEQ ID NO: 64871
  derived and/or modified sequence opt1 from hemagglutinin__InfluenzaA__ADQ28031

SEQ ID NO: 67234 - RNA, 1701 nt, Artificial Sequence; identical to SEQ ID NO: 63919
  derived and/or modified sequence opt1 from hemagglutinin__InfluenzaA__ADQ28032

SEQ ID NO: 67235 - RNA, 1701 nt, Artificial Sequence
  derived and/or modified sequence opt1 from hemagglutinin__InfluenzaA__ADQ28034
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggaccaucguggagcccggcgacaagaucaccuucgaggcgaccgggaaccugguggucccccgguacgccuucgccauggagcgcaacgccggcuccggcaucaucaucagcgacacgcccgugcacgacugcaacacgaccugccagaccccgaagggggccaucaacaccucccuccccuuccagaacauccaccccaucaccaucggcaagugccccaaguacgucaagagcaccaagcugcggcuggcgaccgggcuccgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaaccggaaggucgacgacggguuccuggacaucuggaccuacaacgccgagcuccuggugcugcucgagaacgagcgcacccuggacuaccacgacagcaacgugaagaaccuguacgagaagguccggucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcuggagagcacccggaucuaccagauccucgcgaucuacuccaccgucgccagcagccuggugcugguggucucccucggcgccaucagcuucuggaugugcuccaacggcagccugcagugccgcaucugcaucuga

SEQ ID NO: 67236 - RNA, 1701 nt, Artificial Sequence
  derived and/or modified sequence opt1 from hemagglutinin__InfluenzaA__ADQ28035
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcggccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 67237 - RNA, 1701 nt, Artificial Sequence; identical to SEQ ID NO: 63677
  derived and/or modified sequence opt1 from hemagglutinin__InfluenzaA__ADQ28036

SEQ ID NO: 67238 - RNA, 1701 nt, Artificial Sequence; identical to SEQ ID NO: 63677
  derived and/or modified sequence opt1 from hemagglutinin__InfluenzaA__ADQ28037

SEQ ID NO: 67239 - RNA, 1701 nt, Artificial Sequence; identical to SEQ ID NO: 63919
  derived and/or modified sequence opt1 from hemagglutinin__InfluenzaA__ADQ28038

SEQ ID NO: 67240 - RNA, 1701 nt, Artificial Sequence; identical to SEQ ID NO: 63677
  derived and/or modified sequence opt1 from hemagglutinin__InfluenzaA__ADQ28039

SEQ ID NO: 67241 - RNA, 1701 nt, Artificial Sequence; identical to SEQ ID NO: 63919
  derived and/or modified sequence opt1 from hemagglutinin__InfluenzaA__ADQ28040

SEQ ID NO: 67242 - RNA, 1701 nt, Artificial Sequence; identical to SEQ ID NO: 63919
  derived and/or modified sequence opt1 from hemagglutinin__InfluenzaA__ADQ28041

SEQ ID NO: 67243 - RNA, 1701 nt, Artificial Sequence
  derived and/or modified sequence opt1 from hemagglutinin__InfluenzaA__ADQ28043
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgacggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 67244 - RNA, 1701 nt, Artificial Sequence; identical to SEQ ID NO: 63919
  derived and/or modified sequence opt1 from hemagglutinin__InfluenzaA__ADQ28044

SEQ ID NO: 67245 - RNA, 1701 nt, Artificial Sequence
  derived and/or modified sequence opt1 from hemagglutinin__InfluenzaA__ADQ28045
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67246 - RNA, 1701 nt, Artificial Sequence; identical to SEQ ID NO: 64147
  derived and/or modified sequence opt1 from hemagglutinin__InfluenzaA__ADQ28047

SEQ ID NO: 67247 - RNA, 1701 nt, Artificial Sequence; identical to SEQ ID NO: 63677
  derived and/or modified sequence opt1 from hemagglutinin__InfluenzaA__ADQ28048

SEQ ID NO: 67248 - RNA, 1701 nt, Artificial Sequence; identical to SEQ ID NO: 63919
  derived and/or modified sequence opt1 from hemagglutinin__InfluenzaA__ADQ28049

SEQ ID NO: 67249 - RNA, 1701 nt, Artificial Sequence; identical to SEQ ID NO: 63677
  derived and/or modified sequence opt1 from hemagglutinin__InfluenzaA__ADQ28050

SEQ ID NO: 67250 - RNA, 1701 nt, Artificial Sequence
  derived and/or modified sequence opt1 from hemagglutinin__InfluenzaA__ADQ28051
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67251 - RNA, 1701 nt, Artificial Sequence; identical to SEQ ID NO: 63677
  derived and/or modified sequence opt1 from hemagglutinin__InfluenzaA__ADQ28053

SEQ ID NO: 67252 - RNA, 1701 nt, Artificial Sequence; identical to SEQ ID NO: 63919
  derived and/or modified sequence opt1 from hemagglutinin__InfluenzaA__ADQ28055

SEQ ID NO: 67253 - RNA, 1701 nt, Artificial Sequence
  derived and/or modified sequence opt1 from hemagglutinin__InfluenzaA__ADQ28056
auggaggccauccuggugguccuccuguacaccuucgccaccgcggacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 67254 - RNA, 1701 nt, Artificial Sequence; identical to SEQ ID NO: 63677
  derived and/or modified sequence opt1 from hemagglutinin__InfluenzaA__ADQ28057

SEQ ID NO: 67255 - RNA, 1701 nt, Artificial Sequence; identical to SEQ ID NO: 63677
  derived and/or modified sequence opt1 from hemagglutinin__InfluenzaA__ADQ28058

SEQ ID NO: 67256 - RNA, 1701 nt, Artificial Sequence
  derived and/or modified sequence opt1 from hemagglutinin__InfluenzaA__ADQ28059
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccucguggagcccggggacaagaucaccuucgaggcgaccggcaaccugguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 67257 - RNA, 1701 nt, Artificial Sequence; identical to SEQ ID NO: 63677
  derived and/or modified sequence opt1 from hemagglutinin__InfluenzaA__ADQ28060

SEQ ID NO: 67258 - RNA, 1701 nt, Artificial Sequence
  derived and/or modified sequence opt1 from hemagglutinin__InfluenzaA__ADQ28061
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccaacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 67259 - RNA, 1701 nt, Artificial Sequence
  derived and/or modified sequence opt1 from hemagglutinin__InfluenzaA__ADQ28063
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggaaccaggagggccgcaugaacuaccacuggacccuggugaagcccggggacaagaucaccuucgaggcgaccggcaaccucguggucccccgguacgccuucgccguggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 67260 - RNA, 1701 nt, Artificial Sequence; identical to SEQ ID NO: 64425
  derived and/or modified sequence opt1 from hemagglutinin__InfluenzaA__ADQ28064

SEQ ID NO: 67261 - RNA, 1701 nt, Artificial Sequence
  derived and/or modified sequence opt1 from hemagglutinin__InfluenzaA__ADQ28065
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccggccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacccaggugcacgacugcaacacgaccugccagacccccaagggggccaucaacacgucccugccguuccagaacauccaccccaucaccaucggcaagugccccaaguacgucaagagcaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuacccgaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 67262 - RNA, 1701 nt, Artificial Sequence
  derived and/or modified sequence opt1 from hemagglutinin__InfluenzaA__ADQ28066
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgcggguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 67263 - RNA, 1701 nt, Artificial Sequence
  derived and/or modified sequence opt1 from hemagglutinin__InfluenzaA__ADQ28067
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucaacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67264 - RNA, 1701 nt, Artificial Sequence
  derived and/or modified sequence opt1 from hemagglutinin__InfluenzaA__ADQ28068
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgagaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgcggacgccuacguguucgugggcaccucccgguacagcaagaaguucaagcccgagaucgccauccgcccgaagguccgggaccaggagggccgcaugaacuaccacuggacccuggugaagcccggggacaagaucaccuucgaggccacgggcaaccucguggucccccgguacgccuucgcgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 67265 - RNA, 1701 nt, Artificial Sequence; identical to SEQ ID NO: 67263
  derived and/or modified sequence opt1 from hemagglutinin__InfluenzaA__ADQ28069

SEQ ID NO: 67266 - RNA, 1701 nt, Artificial Sequence
  derived and/or modified sequence opt1 from hemagglutinin__InfluenzaA__ADQ28070
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgccggcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 67267 - RNA, 1701 nt, Artificial Sequence
  derived and/or modified sequence opt1 from hemagglutinin__InfluenzaA__ADQ28071
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 67268 - RNA, 1701 nt, Artificial Sequence; identical to SEQ ID NO: 64621
  derived and/or modified sequence opt1 from hemagglutinin__InfluenzaA__ADR32361

SEQ ID NO: 67269 - RNA, 1689 nt, Artificial Sequence
  derived and/or modified sequence opt1 from hemagglutinin__InfluenzaA__ADT78887
auggcccugaucuaccucauccugcuguucaccagcgugcgcggcgaccagaucugcaucggguaccacgccaacaacuccaccgagaaggucgacacgauccucgagcggaacgugaccgugacccacgcgaaggacauccuggagaagacccacaacggcaagcugugcaagcucaacgggaucccgccccuggagcugggcgacugcagcaucgccggguggcuccugggcaaccccgagugcgaccgccugcuccggguccccgagugguccuacaucauggagaaggagaaccccaaguacagccugugcuacccgggcuccuucaacgacuacgaggagcugaagcaccucaucagcuccgugaagcacuucgagaaggugaagauccugcccaaggacggguggacgcagcacaccaccaccggcgggagccgcgccugcgccgucuccggcaaccccagcuucuuccggaacaugguguggcugacgaagaaggggcccaacuacccgguggccaagggcuccuacaacaacaccagcggcgagcagaugcucaucaucuggggcguccaccaccccaacgacgaggcggagcagcgcgcccuguaccagaagguggggaccuacguguccgccagcaccuccacgcugaacaagcggagcacccccgagaucgccgcgcgccccgaggucaacgggcucggcucccggauggaguucagcuggacccugcuggacaugugggacaccaucaacuucgaguccacgggcaaccucguggccccggaguacggguucaagaucagcaagcgcggcagcuccggggugaugaagaccgagggcacccuggagaacugcgagaccaagugccagacgccccugggggccaucaacaccacccuccccuuccacaacguccacccccugaccaucggcgagugcccgaaguacgucaagagcgagaagcuggugcucgccacgggccugcggaacgugccccagaucgagucccgcgggcuguucggcgccaucgcgggguucaucgagggcggguggcagggcaugguggacggcugguacggguaccaccacagcaacgaccagggcuccggguacgccgccgacaaggagagcacccagaaggccuucgacggcaucaccaacaaggugaacuccgucaucgagaagaugaacacccaguucgaggccguggggaaggaguucagcaaccucgagaagcggcuggagaaccugaacaagaagauggaggacggcuuccucgacguguggacguacaacgcggagcugcugguccucauggagaacgagcgcacccuggacuuccacgacuccaacgugaagaaccuguacgacaagguccggaugcagcuccgcgacaacgugaaggagcugggcaacgggugcuucgaguucuaccacaagugcgacgacgagugcauggacagcgugaagaacggcaccuacgacuaccccaaguacgaggaggaguccaagcugaaccggaacgagaucaagggggucaagcucagcuccaugggcguguaccagauccuggccaucuacgccaccguggccggcagccugucccucgccaucaugauggcggggaucagcuucuggaugugcuccaacggcagccugcagugccgcaucugcaucuga

SEQ ID NO: 67270 - RNA, 1701 nt, Artificial Sequence
  derived and/or modified sequence opt1 from hemagglutinin__InfluenzaA__ADT78908
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaaggcgccccuccagcuggggaagugcaacaucgccggcugggugcuggggaacccggagugcgagagccuccuguccaaccggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggagcgcuccuggccgaagcacaacaccacgcgcggggucaccgccgccugcagccacgcgcggaaguccagcuucuacaagaaccugguguggcugaccgaggccaacggcuccuaccccaaccucagcaaguccuacgugaacaaccaggagaaggagguccuggugcuguggggcgugcaccaccccagcaacaucgaggaccagcggacccucuaccgcaaggacaacgccuacgucagcgugguguccagcaacuacaaccggcgcuucacgcccgagaucgccaagcggccgaagguccgcgaccagcccggccggaugaacuacuacuggacccugcuggagcccggggacaccaucaucuucgaggccaccggcaaccucaucgcgcccugguacgccuucgcccugucccgcggcccggggagcggcaucaucacguccaacgcccccauggacgagugcgacaccaagugccagacgccccagggggccaucaacagcucccugcccuuccagaacauccacccggugaccaucggcgagugccccaaguacgugcggagcaccaagcuccgcauggucaccggccugcggaacauccccuccauccagagccgcgggcuguucggcgcgaucgccggguucaucgagggcggguggaccggcaugauggacggcugguacggguaccaccaccagaacgagcagggcuccggguacgccgccgaccagaaguccacccagaacgccaucaacggcaucacgaacaaggugaacagcgugaucgagaagaugaacacccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacgcuggacuuccacgacagcaacgucaagaaccuguacgagaaggugaagaaccagcuccggaacaacgccaaggagcugggcaacgggugcuucgaguucuaccacaagugcgacaacgagugcauggaguccgucaagaacggcaccuacgacuaccccaaguacagcgaggaguccaagcugaaccgcgagaagaucgacggggugaagcucgagagcaugggcguguaccgcauccuggccaucuacuccaccgucgccagcagccuggugcuccuggugucccugggggcgaucagcuucuggaugugcuccaacggcagccuccagugccggaucugcaucuga

SEQ ID NO: 67271 - RNA, 1701 nt, Artificial Sequence
  derived and/or modified sequence opt1 from hemagglutinin__InfluenzaA__ADT78929
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagagccuccuguccaagcggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggagcgcuccuggccgaagcacaacaucacccggggcgugacggccgccugcagccacgcgggcaaguccagcuucuacaagaaccugcuguggcucaccgagaccaagggguccuaccccaaccugagcaaguccuacgucaacaacaaggagaaggaggugcuggugcucuggggcguccaccaccccagcaacaucgaggaccagaagacccuguaccgcaaggagaacgccuacgugagcguggucuccagcaacuacaaccggcgcuucacgcccgagaucgccgagcggccgaaggugcgcgggcaggccggccggaugaacuacuacuggacccugcucgagcccggcgacaccaucaucuucgaggccaacgggaaccugaucgcgcccugguacgccuucgcccugucccgcggccucgggagcggcaucaucaccuccaacgccagcauggacgagugcgacacgaagugccagacgccccagggcgccaucaacuccagccugccguuccagaacauccaccccgugaccaucggggagugccccaaguacgucaaguccaccaagcugcggauggugaccggccuccgcaacauccccagcauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacgcaguucaccgcggugggcaaggaguucaacaagcuggagaagcgcauggagaaccucaacaagaagguggacgacggguuccuggacaucuggaccuacaacgccgagcugcucguccugcuggagaacgagcggacccucgacuuccacgacuccaacgugaagaaccuguacgagaaggugaagaaccagcugcgcaacaacgccaaggagaucggcaacgggugcuucgaguucuaccacaagugcaacaacgagugcauggagagcgucaagaacggcacguacgacuacccgaaguacuccgaggagagcaagcucaaccgggagaagaucgacggggugaagcuggaguccaugggcgucuaccagauccuggccaucuacagcaccguggccagcucccucgugcugcuggucagccucggcgcgaucuccuucuggaugugcagcaacgggucccugcagugccgcaucugcaucuga

SEQ ID NO: 67272 - RNA, 1701 nt, Artificial Sequence
  derived and/or modified sequence opt1 from hemagglutinin__InfluenzaA__ADT78936
augaaggccaagcugcucgugcugcugugcgcccucagcgcgaccuacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaaggcgccccuccagcuggggaagugcaacaucgccggcuggauccuggggaacccggagugcgagagccuccuguccaagcggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggaguccagcuggccgaagcacaacaccacgcgcggggucaccgccgccugcucccacgcgcgcaagagcuccuucuacaagaaccugcuguggcucaccgaggccaacggcagcuaccccaaccuguccaagagcuacgugaacaaccaggagaaggaggugcugguccucuggggcgugcaccaccccagcaacaucgaggaccagcggacccuguaccggaaggagaacgccuacguguccgucgugagcuccaacuacaaccgccgguucacgcccgagaucgccgagcgcccgaaggugcggaaccaggccggccgcaugaacuacuacuggacccugcucgagcccggggacaccaucaucuucgaggcgaacggcaaccugaucgcccccugguacgccuucgcccugagccggggccucggguccggcaucaucaccagcaacgccuccauggacgagugcgacacgaagugccagacgccccagggggcgaucaacagcucccugccguuccagaacauccaccccgucaccaucggcgagugccccaaguacgucaagagcaccaagcugcgcauggugaccggccuccggaacauccccuccauccagagccgcgggcuguucggcgccaucgccggguucaucgagggcggguggaccggcaugauggacggcugguacggguaccaccaccagaacgagcagggcuccggguacgccgccgaccagaaguccacccagaacgcgaucaacggcaucaccaacaaggugaacagcgugaucgagaagaugaacacgcaguucaccgccguggggaaggaguucaacaagcuggagaagcggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagaaccagcugcggaacaacgccaaggagcucggcaacgggugcuucgaguucuaccacaagugcgacaacgagugcauggaguccgugaagaacggcacguacgacuacccgaaguacagcgaggaguccaagcugaaccgcgagaagaucgacggggucaagcuggagagcaugggcguguaccggauccucgccaucuacagcaccguggcguccagccugguccugcucgugucccugggggccaucagcuucuggaugugcuccaacggcagccugcagugccgcaucugcaucuga

SEQ ID NO: 67273 - RNA, 1689 nt, Artificial Sequence
  derived and/or modified sequence opt1 from hemagglutinin__InfluenzaA__ADT78961
auggccaucaucugccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaagaaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggagacguacguguccgucagcaccuccacccugaacaagcgcagcacccccaagaucgccacgcggcccgaggugaacgggcucgggucccgcauggaguucagcuggacccugcuggacaugugggacaccaucaacuucgaguccaccggcaaccucaucgcccccgaguacggcuucaagaucagcaagcgggggagcuccggcaucaugaagacggaggggacccuggagaacugcgagaccaagugccagaccccgcugggcgccaucaacacgacccuccccuuccacaacgugcacccccugaccaucggggagugccccaaguacgucaagagcgagaagcuggugcucgcgaccggcccgcgcaacgugccccagaucgagucccggggccuguucggggccaucgccggcuucaucgagggcggguggcaggggauggucgacggcugguacggcuaccaccacagcaacgaccagggguccggcuacgccgccgacaaggagagcacgcagaaggcguucgacgggaucaccaacaaggugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacggcugcuucgaguucuaccacaagugcgacgacgagugcaugaacagcgugaagaacgggaccuacgacuaccccaaguacgaggaggaguccaagcugaaccggaacgagaucaagggcgugaagcugagcuccaugggggucuaccagauccucgugaucuacgccaccguggccggcagccugucccuggcgaucaugauggccggcaucagcuucuggaugugcuccaacgggagccuccagugccgcaucugcaucuga

SEQ ID NO: 67274 - RNA, 1701 nt, Artificial Sequence; identical to SEQ ID NO: 61772
  derived and/or modified sequence opt1 from hemagglutinin__InfluenzaA__ADT78971

SEQ ID NO: 67275 - RNA, 1701 nt, Artificial Sequence; identical to SEQ ID NO: 61313
  derived and/or modified sequence opt1 from hemagglutinin__InfluenzaA__ADT79010

SEQ ID NO: 67276 - RNA, 1701 nt, Artificial Sequence; identical to SEQ ID NO: 61772
  derived and/or modified sequence opt1 from hemagglutinin__InfluenzaA__ADT79030

SEQ ID NO: 67277 - RNA, 1701 nt, Artificial Sequence; identical to SEQ ID NO: 62350
  derived and/or modified sequence opt1 from hemagglutinin__InfluenzaA__ADT79050

SEQ ID NO: 67278 - RNA, 1701 nt, Artificial Sequence
  derived and/or modified sequence opt1 from hemagglutinin__InfluenzaA__ADT79108
augaaggcccgccugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccggcugaagggcaucgcgccccuccagcuggggaagugcaacaucgccggcuggauccuggggaacccggagugcgagagccuccuguccaaccgcagcugguccuacaucgccgagacccccaacagcgagaacgggaccugcuaccccggcgacuucgccgacuacgaggagcugcgggagcagcucuccagcguguccagcuucgagcgcuucgagaucuuccccaaggagcgguccuggccgaagcacaacaucacccgcggggugacggccgccugcagccacgcgaagaaguccagcuucuacaagaaccugcuguggcucaccgaggccaacggcuccuaccccaaccugaucaagagcuacgucaacaacaaggagaaggaggugcuggugcucuggggcguccaccaccccuccaacaucgaggaccagcggacccuguaccgcaaggagaacgccuacgugagcguggucagcuccaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugagccgcgggcucggcuccgggaucaucaccagcaacgccuccauggacgagugcgacaccaagugccagacgccccagggcgcgaucaacagcucccugccguuccagaacauccaccccgugaccaucggcgagugccccaaguacguccggagcaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgccgaccagaaguccacgcagaacgcgaucaacgggaucaccaacaaggucaacagcgugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacagcaacgugaagaaccuguacgagaaggucaagaaccagcugcggaacaacgccaaggagaucgggaacggcugcuucgaguucuaccacaagugcgacaacgagugcauggaguccgugaagaacgggaccuacgacuacccgaaguacagcgaggaguccaagcucaaccgcgagaagaucgacggcgucaagcuggagagcauggggguguaccagauccuggccaucuacuccaccguggcgagcagccucguccugcuggugucccucggcgccaucagcuucuggaugugcuccaacggcagccugcagugccgcaucugcaucuga

SEQ ID NO: 67279 - RNA, 1689 nt, Artificial Sequence
  derived and/or modified sequence opt1 from hemagglutinin__InfluenzaA__ADT79119
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccucggcgggcgcauggaguucagcuggacccugcuggacaugugggacaccaucaacuucgaguccaccggcaaccucaucgcccccgaguacggguucaagaucagcaagcggggcuccagcgggaucaugaagacggagggcacccugggcaacugcgagaccaagugccagaccccgcugggggccaucaacacgacccuccccuuccacaacgugcacccccugaccaucggcgagugccccaaguacgucaagagcgagaagcuggugcucgcgaccgggcugcgcaacgugccgcagaucgagucccggggccuguucggggccaucgccggcuucaucgagggcggguggcagggcauggucgacgggugguacggcuaccaccacagcaacgaccagggguccggcuacgccgccgacaaggagagcacgcagaaggcguucgacggcaucaccaacaaggugaacuccgugaucgagaagaugaacacccaguucgaggccgucgggaaggaguucagcaaccucgagcgccggcuggagaaccugaacaagaagauggaggacggcuuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcuggggaacggcugcuucgaguucuaccacaagugcgacgacgagugcaugaacagcgugaagaacggcaccuacgacuaccccaaguacgaggaggaguccaagcugaaccggaacgagaucaagggggugaagcucagcuccaugggcgucuaccagauccuggccaucuacgccaccguggcggggagccugucccucgccaucaugauggccggcaucagcuucuggaugugcuccaacgggagccugcagugccgcaucugcaucuga

SEQ ID NO: 67280 - RNA, 1689 nt, Artificial Sequence
  derived and/or modified sequence opt1 from hemagglutinin__InfluenzaA__ADT79129
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcgacggccucugcuacccgggguccuucaacgacuacgaggagcugaagcaccuccugagcuccgugaagcacuucgagaaggugaagauccugcccaaggaccgguggacgcagcacaccaccaccggcgggagccgcgccugcgccgucuccggcaaccccagcuucuuccggaacaugaucuggcugacgaagaagggguccaacuaccccguggcgaagggcagcuacaacaacaccuccggcgagcagaugcucaucaucuggggcgugcaccacccgaacgacgagaccgagcagcgcacccuguaccagaacgucgggacguacgugagcguggucaccuccacccugaacaagcggagcacccccaagaucgccacgcgccccaaggugaacgggcucggcggccggauggaguucuccuggacccugcuggacaugugggacaccaucaacuucgagagcaccgggaaccucaucgcccccgaguacggcuucaagaucuccaagcgcgggagcuccggcaucaugaagacggaggggacccuggagaacugcgagaccaagugccagaccccgcugggcgccaucaacacgacccuccccuuccacaacgugcacccccuggcgaucggcgagugccccaaguacgucaagagcgagaagcuggugcucgccaccgggcugcggaacgugccgcagaucgagagccgcggccuguucggggccaucgccggcuucaucgagggcggguggcagggcauggucgacgggugguacggcuaccaccacuccaacgaccaggggagcggcuacgccgcggacaaggaguccacccagcgggccuucgacgggaucacgaacaaggugaacagcgugaucgagaagaugaacacccaguucgaggccgucggcaaggaguucuccaaccucgagcgccggcuggagaaccugaacaagaagauggaggacggcuuccucgacguguggaccuacaacgccgagcugcuggugcucauggagaacgagcgcacccuggacuuccacgacagcaacgucaagaaccuguacgacaaggugcggaugcagcuccgcgacaacgucaaggagcuggggaacggcugcuucgaguucuaccacaagugcgacgacgagugcaugaacuccgugaagaacgggacguacgacuaccccaaguacgaggaggagagcaagcugaaccggaacgagaucaagggcgugaagcucuccagcaugggcgucuaccagauccuggccaucuacgcgaccguggccgggucccugagccucgccaucaugauggccggcaucuccuucuggaugugcagcaacgggucccugcagugccgcaucugcaucuga

SEQ ID NO: 67281 - RNA, 1701 nt, Artificial Sequence
  derived and/or modified sequence opt1 from hemagglutinin__InfluenzaA__ADT79232
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacaagcaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgacgugaaguccacgcagaacgcgaucgacgagaucaccaacaaggucaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccguggccagcucccuggugcuggucgugagccucggggccaucuccuucuggaugugcagcaacggcucccugcagugccggaucugcaucuga

SEQ ID NO: 67282 - RNA, 1701 nt, Artificial Sequence
  derived and/or modified sequence opt1 from hemagglutinin__InfluenzaA__ADT79242
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67283 - RNA, 1701 nt, Artificial Sequence
  derived and/or modified sequence opt1 from hemagglutinin__InfluenzaA__ADT91182
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccaccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccacccgcccacgagcgcggaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucaccuucgaggccacgggcaaccucguggucccgcgguacgcguucgccauggagcgcaacgccggguccggcaucaucaucagcgacacccccgugcacgacugcaacacgaccugccagacccccaagggcgccaucaacaccucccugcccuuccagaacauccacccgaucaccaucgggaagugccccaaguacgucaagagcaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacggcaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcucccuggugcucguggucagccugggcgccaucagcuucuggaugugcuccaacggcagccugcagugccggaucugcaucuga

SEQ ID NO: 67284 - RNA, 1701 nt, Artificial Sequence
  derived and/or modified sequence opt1 from hemagglutinin__InfluenzaA__ADU20561
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 67285 - RNA, 1701 nt, Artificial Sequence
  derived and/or modified sequence opt1 from hemagglutinin__InfluenzaA__ADU20562
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaagaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67286 - RNA, 1701 nt, Artificial Sequence
  derived and/or modified sequence opt1 from hemagglutinin__InfluenzaA__ADU25478
auggaggccaagcuguucguccucuucugcgccuucaccgcgcugaaggccgacaccaucugcgugggcuaccacgccaacaacagcacggacaccguggacaccauccuggagcgcaacgugaccgucacgcacuccgugaaccuccuggagagcucccacaacgggaagcugugcagccucaacggcaaggcgccccugcagcuggggaacugcaacguggccggcuggauccucgggaacccggagugcgaccugcugcucaccgucaacuccuggagcuacaucaucgagaccuccaccagcaagaacggcgccugcuaccccggcgaguucgccgacuacgaggagcugcgggagcagcuguccacggugagcuccuucgagcgcuucgagaucuuccccaaggccaccagcuggcccaaccacgagaccaccaaggggacgaccguggccugcucccacagcggcgcgaacuccuucuaccggaaccuccuguggaucgucaagaaggggaacagcuacccgaagcuguccaagagcuacaccaacaacaagggcaaggaggugcucgugaucuggggcguccaccacccgcccaccgacuccgaccagcagacgcuguaccagaacaaccacaccuacgugagcguggggagcuccaaguacuaccagcgcuucacccccgagaucgucacccggcccaaggugcgcgagcaggccggccggaugaacuacuacuggacgcugcucgaccagggggacaccaucaccuucgaggccaccggcaaccugaucgcccccuggcacgccuucgcgcugaacaaggggagcuccagcggcaucaugauguccgacgcccacgugcacaacugcacgaccaagugccagacgccccacggcgcccucaagagcaaccugcccuuccagaacguccacccgaucaccaucggggagugccccaaguacgugaaguccacccagcugcgcauggccaccggccuccggaacauccccagcauccagucccgcgggcuguucggcgccaucgcgggguucaucgagggcggcuggaccgggaugaucgacggcugguacggguaccaccaccagaacgagcagggcagcggguacgccgccgaccagaaguccacccagaucgccaucgacggcaucagcaacaaggugaacuccgucaucgagaagaugaacgugcaguucacgagcgugggcaaggaguucaacaaccuggagaagcggaucgagaaccucaacaagaaggucgacgacggguuccuggacaucuggaccuacaacgccgagcugcucauccugcuggagaacgagcgcacccucgacuuccacgacuucaacgugaagaaccuguacgagcgggucaagucccagcugcgcaacaacgcgaaggagaucggcaacgggugcuucgaguucuaccacaagugcaacaacgagugcauggagagcgugaagaacggcaccuacaacuacccccgguacuccgaggagagcaagcucaaccgcgaggagaucgacggggugaagcuggaguccgucggcgugcaccagauccuggccaucuacagcacgguggccagcucccucguccugcuggugagccucggcgccaucuccuucuggaugugcagcaacgggucccugcagugccggaucugcaucuga

SEQ ID NO: 67287 - RNA, 1701 nt, Artificial Sequence
  derived and/or modified sequence opt1 from hemagglutinin__InfluenzaA__ADU59558
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 67288 - RNA, 1701 nt, Artificial Sequence; identical to SEQ ID NO: 63677
  derived and/or modified sequence opt1 from hemagglutinin__InfluenzaA__ADU59579

SEQ ID NO: 67289 - RNA, 1701 nt, Artificial Sequence; identical to SEQ ID NO: 63677
  derived and/or modified sequence opt1 from hemagglutinin__InfluenzaA__ADU59590

SEQ ID NO: 67290 - RNA, 1701 nt, Artificial Sequence; identical to SEQ ID NO: 63677
  derived and/or modified sequence opt1 from hemagglutinin__InfluenzaA__ADU59601

SEQ ID NO: 67291 - RNA, 1701 nt, Artificial Sequence; identical to SEQ ID NO: 63677
  derived and/or modified sequence opt1 from hemagglutinin__InfluenzaA__ADU59612

SEQ ID NO: 67292 - RNA, 1701 nt, Artificial Sequence; identical to SEQ ID NO: 63677
  derived and/or modified sequence opt1 from hemagglutinin__InfluenzaA__ADU59768

SEQ ID NO: 67293 - RNA, 1701 nt, Artificial Sequence; identical to SEQ ID NO: 63677
  derived and/or modified sequence opt1 from hemagglutinin__InfluenzaA__ADU59769

SEQ ID NO: 67294 - RNA, 1701 nt, Artificial Sequence; identical to SEQ ID NO: 63677
  derived and/or modified sequence opt1 from hemagglutinin__InfluenzaA__ADU59771

SEQ ID NO: 67295 - RNA, 1701 nt, Artificial Sequence; identical to SEQ ID NO: 63677
  derived and/or modified sequence opt1 from hemagglutinin__InfluenzaA__ADU59772

SEQ ID NO: 67296 - RNA, 1701 nt, Artificial Sequence; identical to SEQ ID NO: 63677
  derived and/or modified sequence opt1 from hemagglutinin__InfluenzaA__ADU59774

SEQ ID NO: 67297 - RNA, 1701 nt, Artificial Sequence; identical to SEQ ID NO: 63677
  derived and/or modified sequence opt1 from hemagglutinin__InfluenzaA__ADU59906

SEQ ID NO: 67298 - RNA, 1701 nt, Artificial Sequence; identical to SEQ ID NO: 63677
  derived and/or modified sequence opt1 from hemagglutinin__InfluenzaA__ADU59916

SEQ ID NO: 67299 - RNA, 1701 nt, Artificial Sequence; identical to SEQ ID NO: 63677
  derived and/or modified sequence opt1 from hemagglutinin__InfluenzaA__ADU76756

SEQ ID NO: 67300 - RNA, 1701 nt, Artificial Sequence; identical to SEQ ID NO: 63677
  derived and/or modified sequence opt1 from hemagglutinin__InfluenzaA__ADU76757

SEQ ID NO: 67301 - RNA, 1701 nt, Artificial Sequence; identical to SEQ ID NO: 63677
  derived and/or modified sequence opt1 from hemagglutinin__InfluenzaA__ADU76758

SEQ ID NO: 67302 - RNA, 1701 nt, Artificial Sequence; identical to SEQ ID NO: 63677
  derived and/or modified sequence opt1 from hemagglutinin__InfluenzaA__ADU76759

SEQ ID NO: 67303 - RNA, 1701 nt, Artificial Sequence; identical to SEQ ID NO: 64037
  derived and/or modified sequence opt1 from hemagglutinin__InfluenzaA__ADU76761

SEQ ID NO: 67304 - RNA, 1701 nt, Artificial Sequence; identical to SEQ ID NO: 63677
  derived and/or modified sequence opt1 from hemagglutinin__InfluenzaA__ADU76762

SEQ ID NO: 67305 - RNA, 1701 nt, Artificial Sequence
  derived and/or modified sequence opt1 from hemagglutinin__InfluenzaA__ADU76764
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggaggccuccagcuccaacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaucgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 67306 - RNA, 1701 nt, Artificial Sequence
  derived and/or modified sequence opt1 from hemagglutinin__InfluenzaA__ADU76765
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccagcguggccagcucccugguccucguggugagccugggggccaucuccuucuggaugugcagcaacggcucccugcagugccggaucugcaucuga

SEQ ID NO: 67307 - RNA, 1701 nt, Artificial Sequence; identical to SEQ ID NO: 65274
  derived and/or modified sequence opt1 from hemagglutinin__InfluenzaA__ADU76766

SEQ ID NO: 67308 - RNA, 1701 nt, Artificial Sequence
  derived and/or modified sequence opt1 from hemagglutinin__InfluenzaA__ADU76767
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67309 - RNA, 1701 nt, Artificial Sequence
  derived and/or modified sequence opt1 from hemagglutinin__InfluenzaA__ADU76768
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccuccaaguacagcaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcgccucgcgaccggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucaacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 67310 - RNA, 1701 nt, Artificial Sequence; identical to SEQ ID NO: 63677
  derived and/or modified sequence opt1 from hemagglutinin__InfluenzaA__ADU76769

SEQ ID NO: 67311 - RNA, 1701 nt, Artificial Sequence; identical to SEQ ID NO: 63677
  derived and/or modified sequence opt1 from hemagglutinin__InfluenzaA__ADU76770

SEQ ID NO: 67312 - RNA, 1701 nt, Artificial Sequence; identical to SEQ ID NO: 63677
  derived and/or modified sequence opt1 from hemagglutinin__InfluenzaA__ADU76771

SEQ ID NO: 67313 - RNA, 1701 nt, Artificial Sequence; identical to SEQ ID NO: 64422
  derived and/or modified sequence opt1 from hemagglutinin__InfluenzaA__ADU76772

SEQ ID NO: 67314 - RNA, 1701 nt, Artificial Sequence; identical to SEQ ID NO: 63677
  derived and/or modified sequence opt1 from hemagglutinin__InfluenzaA__ADU76774

SEQ ID NO: 67315 - RNA, 1701 nt, Artificial Sequence; identical to SEQ ID NO: 63677
  derived and/or modified sequence opt1 from hemagglutinin__InfluenzaA__ADU76775

SEQ ID NO: 67316 - RNA, 1701 nt, Artificial Sequence; identical to SEQ ID NO: 63677
  derived and/or modified sequence opt1 from hemagglutinin__InfluenzaA__ADU76776

SEQ ID NO: 67317 - RNA, 1701 nt, Artificial Sequence; identical to SEQ ID NO: 63677
  derived and/or modified sequence opt1 from hemagglutinin__InfluenzaA__ADU76777

SEQ ID NO: 67318 - RNA, 1701 nt, Artificial Sequence; identical to SEQ ID NO: 63677
  derived and/or modified sequence opt1 from hemagglutinin__InfluenzaA__ADU76778

SEQ ID NO: 67319 - RNA, 1701 nt, Artificial Sequence; identical to SEQ ID NO: 66535
  derived and/or modified sequence opt1 from hemagglutinin__InfluenzaA__ADU76779

SEQ ID NO: 67320 - RNA, 1701 nt, Artificial Sequence; identical to SEQ ID NO: 63677
  derived and/or modified sequence opt1 from hemagglutinin__InfluenzaA__ADU76780

SEQ ID NO: 67321 - RNA, 1701 nt, Artificial Sequence; identical to SEQ ID NO: 65274
  derived and/or modified sequence opt1 from hemagglutinin__InfluenzaA__ADU76781

SEQ ID NO: 67322 - RNA, 1701 nt, Artificial Sequence; identical to SEQ ID NO: 64037
  derived and/or modified sequence opt1 from hemagglutinin__InfluenzaA__ADU76782

SEQ ID NO: 67323 - RNA, 1701 nt, Artificial Sequence
  derived and/or modified sequence opt1 from hemagglutinin__InfluenzaA__ADU76784
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccaacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67324 - RNA, 1701 nt, Artificial Sequence; identical to SEQ ID NO: 63677
  derived and/or modified sequence opt1 from hemagglutinin__InfluenzaA__ADU76785

SEQ ID NO: 67325 - RNA, 1701 nt, Artificial Sequence; identical to SEQ ID NO: 63677
  derived and/or modified sequence opt1 from hemagglutinin__InfluenzaA__ADU76786

SEQ ID NO: 67326 - RNA, 1701 nt, Artificial Sequence
  derived and/or modified sequence opt1 from hemagglutinin__InfluenzaA__ADU76787
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 67327 - RNA, 1701 nt, Artificial Sequence; identical to SEQ ID NO: 67308
  derived and/or modified sequence opt1 from hemagglutinin__InfluenzaA__ADU76788

SEQ ID NO: 67328 - RNA, 1701 nt, Artificial Sequence; identical to SEQ ID NO: 67308
  derived and/or modified sequence opt1 from hemagglutinin__InfluenzaA__ADU76789

SEQ ID NO: 67329 - RNA, 1701 nt, Artificial Sequence; identical to SEQ ID NO: 63677
  derived and/or modified sequence opt1 from hemagglutinin__InfluenzaA__ADU76790

SEQ ID NO: 67330 - RNA, 1701 nt, Artificial Sequence; identical to SEQ ID NO: 63677
  derived and/or modified sequence opt1 from hemagglutinin__InfluenzaA__ADU76791

SEQ ID NO: 67331 - RNA, 1701 nt, Artificial Sequence; identical to SEQ ID NO: 67308
  derived and/or modified sequence opt1 from hemagglutinin__InfluenzaA__ADU76792

SEQ ID NO: 67332 - RNA, 1701 nt, Artificial Sequence
  derived and/or modified sequence opt1 from hemagglutinin__InfluenzaA__ADU76793
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcaccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgucgcgagcagccuggugcucguggucucccugggggccaucagcuucuggaugugcuccaacggcagccugcagugccgcaucugcaucuga

SEQ ID NO: 67333 - RNA, 1701 nt, Artificial Sequence
  derived and/or modified sequence opt1 from hemagglutinin__InfluenzaA__ADU85911
augaaggccaucaucgugguccugcucuacaccuucgccaccgcggacgccgacacgcugugcaucggcuaccacgccaacaacagcaccgacaccguggacaccgugcuggagaagaacgucacggugacccacuccgugaaccuccuggagaacaagcacaacgggaagcugugcaagcucggcgggaucgcgccccugcaccugggcaagugcgacaucgccggguggcuccugggcaacccggagugcgagagccuguucaccgccuccagcugguccuacaucgucgagacccccaacagcgacaacggcacgugcuaccccggggacuucaucaacuacgaggagcuccgcgagcaccuguccagcguguccagcuucgagcgguucgagaucuuccccaaggccaacuccuggccgaaccacgacaccaacaagggcgugaccgccgccugccccuacgcgggggccaacagcuucuaccgcaaccugaucuggcucgucaagaagggcaacuccuaccccaagcugagcaaguccuacaucaacaacaagaagaaggaggugcuggugaucugggggauccaccacccgcccaccagcacggaccagcagacccucuaccagaacgccgacgccuacgucuucgugggcuccagcaaguacuccaagcgguucaagcccgagaucgccgcgcgccccaaggugcgggaccaggccggccgcauggacuacuacuggacccugaucgagcccggggacaccaucacguucgaggccaccggcaaccuggucgugccgcgguacgccuucgccaugaagcgcgggagcggcagcggcaucaucguguccgacgcgcccguccacgacugcaacacgaccugccagacccccaagggggccaucaacaccagccuccccuuccagaacauccacccggugaccaucggcgagugccccaaguacgugaaguccaccaagcugcggauggccacggggcugcgcaacauccccagcauccagucccggggccucuucggggccaucgccggcuuccuggagggcggguggaccggcaugaucgacgggugguacggcuaccaccaccagaacgagcaggggagcggcuacgcggccgaccagaaguccacccagaacgccaucgacggcaucaccaacaaggucaacagcaucaucgagaagaugaacacgcaguucaccgccguggggaaggaguucucccagcuggagaagcgcaucgagagccucaacaacaagguggacgacggcuuccuggacaucuggaccuacaacgccgagcugcucguccugcuggagaacgagcggacccucgacuaccacgacuccaacgugaagaaccuguacgagaagguccgcagccagcugaagaacaacgcgaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccgcccgcaucuaccagauccuggccaucuacagcaccgucgcguccagccucgugcugcuggugucccucggcgccaucagcuucuggaugugcagcaacgggucccugcagugccggaucugcaucuga

SEQ ID NO: 67334 - RNA, 1701 nt, Artificial Sequence; identical to SEQ ID NO: 64841
  derived and/or modified sequence opt1 from hemagglutinin__InfluenzaA__ADV17283

SEQ ID NO: 67335 - RNA, 1701 nt, Artificial Sequence; identical to SEQ ID NO: 64841
  derived and/or modified sequence opt1 from hemagglutinin__InfluenzaA__ADV17293

SEQ ID NO: 67336 - RNA, 1701 nt, Artificial Sequence
  derived and/or modified sequence opt1 from hemagglutinin__InfluenzaA__ADV17303
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaagggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67337 - RNA, 1701 nt, Artificial Sequence; identical to SEQ ID NO: 64841
  derived and/or modified sequence opt1 from hemagglutinin__InfluenzaA__ADV17313

SEQ ID NO: 67338 - RNA, 1701 nt, Artificial Sequence
  derived and/or modified sequence opt1 from hemagglutinin__InfluenzaA__ADV17323
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccaacagcuggcccaaccacgacuccaacaagggcgucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcacgagcgcggaccagcagggccuguaccagaacgccgacgccuacguguucgugggcaccucccgguacagcaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccggagggggccaucaacaccucccugcccuuccagaacauccaccccaucaccaucggcaagugccccaaguacgucaagagcaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucaccaacaaggugaacuacgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 67339 - RNA, 1701 nt, Artificial Sequence
  derived and/or modified sequence opt1 from hemagglutinin__InfluenzaA__ADV17333
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagaaccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucgugguccugcgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcuccggcuggcgaccggccugcgcaacguccccagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuacuacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgggaggagaucgacggcgugaagcuggaguccacccgcaucuaccagauccuggucaucuacagcaccguggcguccagccucgugcuggucgugagccugggggccaucuccuucuggaugugcagcaacggcucccuccagugccggaucugcaucuga

SEQ ID NO: 67340 - RNA, 1701 nt, Artificial Sequence; identical to SEQ ID NO: 63677
  derived and/or modified sequence opt1 from hemagglutinin__InfluenzaA__ADV19019

SEQ ID NO: 67341 - RNA, 1701 nt, Artificial Sequence; identical to SEQ ID NO: 64162
  derived and/or modified sequence opt1 from hemagglutinin__InfluenzaA__ADV41677

SEQ ID NO: 67342 - RNA, 1701 nt, Artificial Sequence
  derived and/or modified sequence opt1 from hemagglutinin__InfluenzaA__ADV58939
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacgagaccuacgacuaccccaaguacagcgaggaggccaagcugaaccgggaggagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 67343 - RNA, 1698 nt, Artificial Sequence
  derived and/or modified sequence opt1 from hemagglutinin__InfluenzaA__ADV69074
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccgaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugagcgccuccugcagccacaacggcaaguccagcuucuaccgcaaccugcuguggcucacggugaagaacgggcuguaccccaaccuguccaagagcuacaccaacgacaaggagaaggagguccucgugcuguggggcgugcaccacccgcccuccaucggggaccagcggacccuguaccacaccgagaacgccuacgucagcguggugagcucccacuacagccgccgguucacgcccgagaucgucaagcgccccaaggugcgggaccaggagggccgcaucaacuacuacuggacccuccuggagcccggcgacaccaucaucugcgaggccaacgggaaccugaucgccccgcgguacgccuucgcccucucccgcggccuggggagcggcaucaucaccuccaacgcgcccaugggcgagugcaacgccaagugccagacgccccagggggccaucaacagcucccugcccuuccagaacgugcacccggucaccaucggcgagugccccaaguacgucaagagcgccaagcuccggauggugaccgggcugcgcaacacccccuccauccagagccggggccuguucggggccaucgcgggcuucaucgagggcggguggacgggcaugguggacgggugguacggcuaccaccaccagaacgagcagggguccggcuacgccgccgaccagaaguccacccagaacgccaucaacggcaucaccaacaaggugaacagcgucaucgagaagaugaacacccaguucacggccguggggaaggaguucaacaagcucgagcgccggauggagaaccugaacaagaagguggacgacggcuuccuggacaucuggaccuacaacgcggagcuccugguccugcucgagaacgagcgcacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcuggaguccauggagguguaccagauccucgccaucuacagcacggucgccagcucccugguguuccugguggcccucggcgcgaucugcuucuggaugugcagcaacgggucccugcagugcaagaucugcaucuga

SEQ ID NO: 67344 - RNA, 1698 nt, Artificial Sequence
  derived and/or modified sequence opt1 from hemagglutinin__InfluenzaA__ADV69075
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccgaccccgagaacggcacgugcuaccccggcuacgugaccgacuacgaggagcugcgcgagcagcucagcuccgucagcuccuucaagcgguucgagaucuucccgaaggagagcuccuggcccaaccacaccgugaccggggugagcgccuccugcagccacaacggcaaguccagcuucuaccgcaaccugcuguggcucacggucaagaacgggcuguaccccaaccuguccaagagcuacaccaacgacaaggagaaggaggugcucgugcuguggggcguccaccacccgcccuccaucggggaccagcggacccuguaccacaccgagaacgccuacgugagcguggucagcucccacuacagccgccgguucacgcccgagaucgugaagcgccccaaggugcgggaccaggagggccgcaucaacuacuacuggacccuccuggagcccggcgacaccaucaucugcgaggccaacgggaaccugaucgccccgcgguacgccuucgcccucucccgcggcuucgggagcggcaucaucaccuccaacgcgcccaugggcgagugcaacgccaagugccagacgccccagggggccaucaacagcucccugcccuuccagaacguccacccggugaccaucggcgagugccccaaguacgucaagagcgccaagcugcggauggugaccgggcuccgcaacacccccuccauccagagccggggccuguucggggccaucgcgggcuucaucgagggcggguggacgggcaugguggacgggugguacggcuaccaccaccccaacgagcagggguccggcuacgccgccgaccagaaguccacccagaacgccaucaacggcaucaccaacaaggucaacagcgugaucgagaagaugaacacccaguucacggccguggggaaggaguucaacaagcuggagcgccggauggagaaccucaacaagaaggucgacgacggcuuccuggacaucuggaccuacaacgcggagcugcucgugcugcuggagaacgagcgcacccucgacuuccacgacagcaacgugaagaaccuguacgagaaggucaagucccagcugaagaacaaggugaaggagaucgggaacggcugcuucgaguucuaccacaagugcaacgacgagugcauggagagcgugaagaacgggaccuacgacuacccgaaguacuccgaggagagcaagcucaaccgggagaagaucgacggcgucaagcuggaguccauggagguguaccagauccuggccaucuacagcacgguggccagcucccucgucuuccugguggcccugggcgccaucugcuucuggaugugcagcaacgggucccuccagugcaagaucugcaucuga

SEQ ID NO: 67345 - RNA, 1698 nt, Artificial Sequence
  derived and/or modified sequence opt1 from hemagglutinin__InfluenzaA__ADV69077
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccgaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugagcgccuccugcagccacaacggcaaguccagcuucuaccgcaaccugcuguggcucacggugaagaacgggcuguaccccaaccuguccaagagcuacaccaacgacaaggagaaggagguccucgugcuguggggcgugcaccacccgcccuccaucggggaccagcggacccuguaccacaccgagaacgccuacgucagcguggugagcucccacuacagccgccgguucacgcccgagaucgucaagcgccccaaggugcgggaccaggagggccgcaucaacuacuacuggacccuccuggagcccggcgacaccaucaucuucgaggccaacgggaaccugaucgccccgcgguacgccuucgcccucucccgcggcuucgggagcggcaucaucaccuccaacgcgcccaugggcgagugcaacgccaagugccagacgccccagggggccaucaacagcucccugcccuuccagaacgugcacccggucaccaucggcgagugccccaaguacgucaagagcgccaagcugcggauggugaccgggcuccgcaacacccccuccauccagagccggggccuguucggggccaucgcgggcuucaucgagggcggguggacgggcaugguggacgggugguacggcuaccaccaccagaacgagcagggguccggcuacgccgccgaccagaaguccacccagaacgccaucaacggcaucaccaacaaggugaacagcgucaucgagaagaugaacacccaguucacggccguggggaaggaguucaacaagcuggagcgccggauggagaaccucaacaagaagguggacgacggcuuccuggacaucuggaccuacaacgcggagcugcucguccugcuggagaacgagcgcacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcucaaccgggagaagaucgacggcgugaagcuggaguccauggagguguaccagauccuggccaucuacagcacggucgccagcucccucguguuccugguggcccugggcgcgaucugcuucuggaugugcagcaacgggucccuccagugcaagaucugcaucuga

SEQ ID NO: 67346 - RNA, 1698 nt, Artificial Sequence
  derived and/or modified sequence opt1 from hemagglutinin__InfluenzaA__ADV69078
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggagcuacaucgucgagacccccaaccccgagaacggcgccugcuaccccggcgaguucgccgacuacgaggagcugcgcgagcagcugagcuccgugagcuccuucgagcgguucgagaucuucccgaaggagagcuccuggcccaaccacacggccgccggggugagcgccuccugcagccacaacggcgagaaguccuucuaccgcaaccucaucuggcugaccaagaagaacgggcuguaccccaaccucagcaaguccuacgagaacgacaaggagaaggagguccugauccuguggggcgugcaccacccgcccaacaucgagaaccagcggacccucuaccgcaccgagaacgccuacgugagcgucgugagcucccacuacagcgggcgguucacgcccgagaucaccaagcgccccaaggugcggaaccaggagggccgcaucaacuacuacuggacccugcuggagcccggcgacaccaucaucuucgaggcgaacgggaaccucaucgccccgugguacgccuucacgcugucccggggccuggggagcggcaucaucaccuccaacgcccccauggacgagugcgacgccaagugccagacgccccagggcgcgaucaacagcucccuccccuuccagaacguccacccggugaccaucggggagugccccaaguacgugcgcagcuccaagcugcggauggucaccggccugcgcaacauccccagcauccagucccggggccucuucggggccaucgccggguucaucgagggcggcuggaccgggaugguggacggcugguacggguaccaccaccagaacgagcagggcagcggguacgccgccgaccaggaguccacccagaacgcgaucaacggcaucaccaacaaggugaacagcgucaucgagaagaugaacacgcaguucaccgccgugggcaaggaguucaacaagcuggagcgccggauggagaaccugaacaagaagguggacgacggguuccucgacaucuggaccuacaacgccgagcugcugguccuccuggagaacgagcgcacccuggacuuccacgacuccaacgucaagagccucuacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagagcaagcugaaccgggagaagaucgacggggugaagcucgacagcaugggcgucuaccgcauccuggccaucuacuccaccguggcgagcucccuggugcuccuggucagccugggcgccaucuccuucuggaugugcagcaacgggucccuccagugccggaucugcaucuga

SEQ ID NO: 67347 - RNA, 1698 nt, Artificial Sequence
  derived and/or modified sequence opt1 from hemagglutinin__InfluenzaA__ADV69079
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucaagacccccaaccccgagaacggcuccugcuaccccggcuacuucgccgacuacgaggagcugcgcgagcagcucagcuccgugagcuccuucgagcgguucgagauguucccgaaggagagcuccuggcccaaccacaacgugaacggggucagcgccuccugcagccacaacggcaagcgcuccuucuaccggaaccugcuguggcucacggggaagaacggccuguaccccaaccugaccaagagcuacgagaacaacaacgagaaggaggugcucauccuguggggcgugcaccaccccuccaacaucggggaccagcgcacccuguaccacaccgagaacgccuacgucagcgugaugagcucccacuacagccggcgcuucacgccggagaucaacaagcggcccaaggugcgcgaccaggagggccggaucaacuacuacuggacccuccuggagcccggggacaccaucaucuucgaggccaacggcaaccugaucgcccccugguacgccuucgcgcucucccgcggguucggcagcggcaucaucaccuccagcgccccgauggacgagugcgacgccaagugccagacgccccgcggggccaucaacuccagccugcccuuccagaacguccaccccgugaccaucggcgagugcccgaaguacgugcgguccgccaagcugcggauggucaccgggcuccgcaacauccccagcauccagucccggggccuguucggggcgaucgccggcuucaucgagggcggguggaccggcaugguggacgggugguacggcuaccaccaccagaacgagcaggggagcggcuacgccgccgaccaggaguccacgcagaacgccaucaacggcaucaccaacaaggugaacagcgucaucgagaagaugaacacccaguucaccgcgguggggaaggaguucaacaagcuggagcgccggauggagaaccucaacaagaagguggacgacggcuuccuggacaucuggacguacaacgccgagcugcucguccugcuggagaacgagcgcacccucgacuuccacgacuccaacgucaagagccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggacagcaugggcgucuaccagauccuggccaucuacuccaccguggccagcucccucgugcugcuggucagccucggggcgaucuccuucuggaugugcagcaacggcucccugcagugccgcaucugcaucuga

SEQ ID NO: 67348 - RNA, 1698 nt, Artificial Sequence
  derived and/or modified sequence opt1 from hemagglutinin__InfluenzaA__ADV69080
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggagcuacaucgucgagacccccaaccccgagaacggcgccugcuaccccggcgaguucgccgacuacgaggagcugcgcgagcagcugagcuccgugagcuccuucgagcgguucgagaucuucccgaaggagagcuccuggcccaaccacacggccgccggggugagcgccuccugcagccacaacggcgagcgcuccuucuaccggaaccucaucuggcugaccaugaagaacgggcuguaccccaaccuccgcaagagcuacgagaacgacaaggagaaggagguccugauccuguggggcgugcaccacccgcccaacaucgagaaccagcggacccucuaccacaccgagaacgccuacguguccgucgugagcagccacuacuccgggcgcuucacgcccgagaucaccaagcggcccaaggugcgcgaccaggagggccggaucaacuacuacuggacccugcuggagcccggcgacaccaucaucuucgaggcgaacgggaaccucaucgccccgugguacgccuucacgcugagccgcggccugggguccggcaucaucaccagcaacgcccccauggacgccugcgacgcgaagugccagacgccccagggcgccaucaacuccagccuccccuuccagaacguccacccggugaccaucggggagugccccaaguacgugcgguccgccaagcugcgcauggucaccggccugcggaacauccccagcauccagucccgcggccucuucggggccaucgccggguucaucgagggcggcuggaccgggaugguggacggcugguacggguaccaccaccagaacgagcagggcagcggguacgcggccgaccaggaguccacccagaacgccaucaacggcaucaccaacaaggugaacagcgucaucgagaagaugaacacgcaguucaccgccgugggcaaggaguucaacaagcuggagcggcgcaucgagaaccugaacaagaagguggacgacggguucaucgacaucuggaccuacaacgccgagcuccugguccugcucgagaacgagcggacccuggacuuccacgacuccaacgucaagagccuguacgagaaggugaagucccagcucaagaacaacgcgaaggagaucggcaacgggugcuucgaguucuaccacaagugcaacaacgagugcauggagagcgugaagaacggcacguacgacuaccccaaguacuccgaggagagcaagcugaaccgcgagaagaucgacggggugaagcuggacuccaugggcgucuaccggauccucgccaucuacagcaccguggccagcucccuggugcugcucgucagccugggcgccaucuccuucuggaugugcagcaacgggucccugcagugccgcaucugcaucuga

SEQ ID NO: 67349 - RNA, 1698 nt, Artificial Sequence
  derived and/or modified sequence opt1 from hemagglutinin__InfluenzaA__ADV69081
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugagcgccuccugcagccacaacggcgaguccagcuucuaccgcaaccugcuguggcucacggugaagaacgggcuguaccccaagcuguccaagagcuacaccaacgacaaggagaaggagguccucgugcuguggggcgugcaccacccgcccaacauccgggaccagcgcacccuguaccacaccgagaacgccuacgucuccguggugagcagccacuacucccggcgcuucacgcccgagaucgucaagcggcccaaggugcgcgaccaggaggggcggaucaacuacuacuggacccuccuggagcccggcgacaccaucaucuucgaggccaacggcaaccugaucgccccgcgcuacgccuucgcccucagccggggguucggcuccgggaucaucaccagcaacgcgcccaugggcgagugcaacgccaagugccagacgccccagggcgccaucaucuccagccugcccuuccagaacgugcacccggucaccaucggggagugccccaaguacgugaaguccgccaagcugcgcauggugaccggccuccggaacacccccagcauccagucccgcgggcuguucggcgccaucgcgggguucaucgagggcggcuggacggggauggucgacggcugguacggguaccaccaccagaacgagcagggcagcggguacgccgccgaccagaaguccacccagaacgccaucaacggcaucaccaacaaggugaacagcgucaucgagaagaugaacacccaguucacggccgugggcaaggaguucaacaagcuggagcggcgcauggagaaccucaacaagaagguggacgacggguuccuggacaucuggaccuacaacgcggagcugcucguccugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcucaaccgcgagaagaucgacggggugaagcuggagagcauggagguguaccagauccuggccaucuacuccacggucgccagcagccucguguuccugguggcccugggcgcgaucugcuucuggaugugcuccaacggcagccuccagugcaagaucugcaucuga

SEQ ID NO: 67350 - RNA, 1698 nt, Artificial Sequence
  derived and/or modified sequence opt1 from hemagglutinin__InfluenzaA__ADV69083
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaacgugaccggggugagcuccagcugcucccacaacggcaagagcuccuucuaccgcaaccuccuguggcugaccgucaagaacgggcucuaccccaaccugagcaagagcuacacgaacaagaaggagaaggaggugcuggugcucuggggcguccaccaccccuccaacaucggggaccagcgggcccuguaccacaccgagaacgccuacgugagcguggucuccagccacuacucccgccgguucaccccggagaucgccaagcgccccaaggugcggaaccaggagggccgcaucaacuacuacuggacccugcucgagcccggcgacacgaucauccuggaggccaacgggaaccugaucgcgccccgguacgccuucgagcucagcaagggccugggguccggcaucaucaccagcaacgccccgaugggcgagugcaacgccaagugccagacgccccagggggccaucaacuccagccugcccuuccagaacgugcaccccgucaccaucggcgagugcccgaaguacgugaaguccgccaagcuccgcauggugaccgggcugcggaacacccccagcauccagucccgcggccuguucggggccaucgcgggcuucaucgagggcggguggaccggcauggucgacgggugguacggcuaccaccaccagaacgagcaggggagcggcuacgccgccgaccagcaguccacccagaacgccaucaacggcaucacgaacaaggugaacagcgucaucgagaagaugaacacccaguucaccgccguggggaaggaguucaacaagcucgagcggcgcauggagaaccugaacaagaagguggacgacggcuuccuggacaucuggaccuacaacgcggagcuccugguccugcucgagaacgagcggacgcuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgcgagaagaucgacggcgugaagcuggaguccaugggcguguacaacauccucgccaucuacagcaccgucgccuccagccuggugcugcucgugucccugggggccaucagcuucuggaugugcuccaacggcagccugcagugccggaucugcaucuga

SEQ ID NO: 67351 - RNA, 1698 nt, Artificial Sequence
  derived and/or modified sequence opt1 from hemagglutinin__InfluenzaA__ADV69084
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaacgugaccggggugagcuccagcugcucccacaacggcaagagcuccuucuaccgcaaccuccuguggcugaccgucaagaacgggcucuaccccaaccugagcaagagcuacacgaacaagaaggagaaggaggugcugauccucuggggcgugcaccaccccuccaacauccgggaccagcgcgcccuguacuacaccgagaacgccuacgucagcgugguguccagccacuacucccggcgcuucaccccggagaucgccaagcggcccaagguccgcaaccaggaggggcggaucaacuacuacuggacccugcucgagcccggcgacacgaucaucuucgaggccaacggcaaccugaucgcgccccgcuacgccuucgagcugagcaagggguucggcuccgggaucaucaccagcgacgccccgaugggcgagugcaacgccaagugccagacgccccagggcgccaucaacuccagccuccccuuccagaacgugcaccccgugaccaucggggagugcccgaaguacguccgguccgccaagcugcgcauggugaccggccugcggaacacccccagcauccagucccgcggccucuucggggccaucgcgggguucaucgagggcggcuggaccgggaugguggacggcugguacggguaccaccaccagaacgagcagggcagcggguacgccgccgaccagcaguccacccagaacgccaucaacggcaucacgaacaaggucaacagcgugaucgagaagaugaacacccaguucaccgccgucggcaaggaguucaacaagcuggagcggcgcauggagaaccugaacaagaagaucgacgacggguuccucgacaucuggaccuacaacgcggagcugcuggugcuccuggagaacgagcggacgcuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggagagcaagcugaaccgcgagaagaucgacggggugaagcucgaguccaugggcgucuacaacauccuggccaucuacagcaccguggccuccagccuggugcuccuggucucccugggcgccaucagcuucuggaugugcuccaacgggagccuccagugccggaucugcaucuga

SEQ ID NO: 67352 - RNA, 1698 nt, Artificial Sequence
  derived and/or modified sequence opt1 from hemagglutinin__InfluenzaA__ADV69085
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaccgugaccggggugagcuccagcugcucccacaacggcaagagcuccuucuaccgcaaccuccuguggcugacgaugaagaacgggcucuaccccaaccugagcaagagcuacaccaacaagaaggagaaggagguccuggugcucuggggcgugcaccaccccuccaacaucggggaccagcgggcccuguaccacaccgagaacgccuacgucagcgugguguccagccacuacucccgccgguucaccccggagaucgccaagcgccccaagguccggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccagccuccccuuccagaacgugcaccccgugaccaucggcgagugcccgaaguacguccgcuccagcaagcugcggauggugaccgggcugcgcaacacccccuccauccagagccggggccucuucggggccaucgccggcuucaucgagggcggguggaccggcaugguggacgggugguacggcuaccaccaccagaacgagcagggguccggcuacgcggccgaccagcagagcacgcagaacgccaucaacggcaucaccaacaaggucaacuccgugaucgagaagaugaacacccaguucaccgccgucgggaaggaguucaacaagcuggagcgccggauggagaaccugaacaagaagaucgacgacggcuuccucgacaucuggacguacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacagcgaggaguccaagcugaaccgggagaagaucgacggcgugaagcucgagagcaugggcgucuacaacauccuggccaucuacuccaccguggccagcucccuggugcuccuggucagccugggggccaucuccuucuggaugugcagcaacggcucccuccagugccgcaucugcaucuga

SEQ ID NO: 67353 - RNA, 1698 nt, Artificial Sequence
  derived and/or modified sequence opt1 from hemagglutinin__InfluenzaA__ADV69086
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugagcuccuucaagcgguucgagaucuucccgaaggagagcuccuggcccaagcacaccgucaccggggugagcgccuccugcagccacaacggcaaguccagcuucuaccgcaaccugcuguggcucacggggaagaacggccuguaccccaaccuguccaagagcuacaccaacgacaaggagaaggaggugcucguccuguggggcgugcaccaccccuccaacaucggggaccagcgggcccuguaccacaaggagaacgccuacgugagcgucgugagcucccacuacagccgccgguucaccccggagaucgugaagcgccccaagguccgggaccaggagggccgcaucaacuacuacuggacccuccuggagcccggggacacgaucaucuucgaggccaacggcaaccugaucgcgccccgguacgccuucgcccucucccgcggguucggcagcggcaucaucaccuccaacgccccgauggacgagugcaacaccaagugccagacgccccagggggccaucaacagcucccugcccuuccagaacgugcaccccgugaccaucggcgagugcccgaaguacgucaagagcgccaagcugcggauggugaccgggcuccgcaacacccccuccauccagagccggggccuguucggggccaucgcgggcuucaucgagggcggguggaccggcaugguggacgggugguacggcuaccaccaccagaacgagcagggguccggcuacgccgccgaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuuccuggacaucuggacguacaacgcggagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgucaagcuggaguccauggagguguaccagauccuggccaucuacagcaccguggccagcucccucgucuuccuggugagccugggcgccaucugcuucuggaugugcuccaacgggagccuccagugccgcaucugcaucuga

SEQ ID NO: 67354 - RNA, 1698 nt, Artificial Sequence
  derived and/or modified sequence opt1 from hemagglutinin__InfluenzaA__ADV69087
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaccgugaacggggugagcuccagcugcucccacaacggcgagagcuccuucuaccgcaaccuccuguggcugaccgucaaggacgggcucuaccccaaccugagcaagagcuacacgaacaagaaggagaaggaggugcuggugcucuggggcguccaccaccccuccaacaucggggaccagcgggcccuguaccacaccgagaacgccuacgugagcguggucuccagccacuacucccgccgguucaccccggagaucgccaagcgccccaaggugcggaaccaggagggccgcaucaacuacuacuggacccugcucgagcccggcgacacgaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccagccuccccuuccagaacgugcaccccgucaccaucggcgagugcccgaaguacgugcgcuccaccaagcugcggauggugaccgggcugcgcaacacccccagcauccagucccggggccucuucggggccaucgccggcuucaucgagggcggguggaccggcauggucgacgggugguacggcuaccaccaccagaacgagcaggggagcggcuacgcggccgaccagcaguccacgcagaacgccaucaacggcaucaccaacaaggugaacagcgucaucgagaagaugaacacccaguucaccgccguggggaaggaguucaacaagcuggagcgccggauggagaaccugaacaagaagaucgacgacggcuuccucgacaucuggacguacaacgccgagcugcuggugcuccuggagaacgagcgcacccuggacuuccacgacuccaacgucaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcucgaguccaugggcguguacaacauccuggccaucuacagcaccguggccuccagccugguccuccuggugucccugggggccaucagcuucuggaugugcuccaacggcagccuccagugccgcaucugcaucuga

SEQ ID NO: 67355 - RNA, 1698 nt, Artificial Sequence
  derived and/or modified sequence opt1 from hemagglutinin__InfluenzaA__ADV69088
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccgugaccggcuggauccuggggaacccggagugcgagcuccugaucagcaagaaguccuggagcuacaucgucgagacgcccaaccccgagaacggcgccugcuaccccggcuacuucgccgacuacgaggagcugcgcgagcagcucuccagcguguccagcuucgagcgguucgagaucuucccgaaggaguccagcuggcccaaccacaacgugaacggggucuccgccagcugcucccacaacggcaagagcuccuucuaccgcaaccugcuguggcucaccgggaagaacggccuguaccccagccugaccaaguccuacgccaacgacaaggagaaggaggugcucauccuguggggcgugcaccaccccagcaacaucggggaccagcggacccuguaccacacggagaacgccuacgucagcgugauguccagccacuacucccgccgguucaccccggagaucagcaagcgccccaaggugcgggaccaggagggccgcaucaacuacuacuggacccuccuggagcccggggacaccaucaucuucgaggccaacggcaaccugaucgcccccugguacgcguucgcccucucccggggguucggcagcggcaucaucacguccagcgccccgauggacgccugcgacgccaagugccagacgccccagggggcgaucaacuccagccugcccuuccagaacguccaccccgugaccaucggcgagugcccgaaguacgugcgcuccaccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgccgaccaggaguccacccagaacgcgcugcacggcaucaccaacaaggugaacagcgucaucgagaagaugaacacgcaguucaccgccguggggaaggaguucaacaagcucgagcgccggauggagaaccugaacaagaagguggacgacggcuuccuggacaucuggaccuacaacgccgagcuccugguccugcucgagaacgagcgcacccuggacuuccacgacuccaacgucaagagccuguacgagaaggugaagauccagcucaagaacaacgccaaggagaucgggaacggcugcuucgaguucuaccacaagugcaacaacgagugcauggaguccgugcggaacgggacguacgacuaccccaaguacagcgaggagagcaagcugaaccgcgagaagaucgacggcgugaagcuggacuccaugggcgucuaccagauccucgccaucuacagcaccguggcguccagccuggugcugcucgucucccugggggccaucagcuucuggaugugcuccaacggcagccugcagugccggaucugcaucuga

SEQ ID NO: 67356 - RNA, 1698 nt, Artificial Sequence
  derived and/or modified sequence opt1 from hemagglutinin__InfluenzaA__ADV69089
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacaacgugaacggggucuccgccagcugcucccacaacggcaagagcuccuucuaccgcaaccugcuguggcucacggggaagaacggccuguaccccaaccugaccaagagcuacgccaacaacaaggagaaggaggugcucauccuguggggcgugcaccaccccuccaacaucggggaccagcggacccuguaccacaccgagaacgccuacgucagcgugaugagcucccacuacagccgccgguucacgccggagaucaccaagcgccccaagauccgggaccaggagggccgcaucaacuacuacuggacccuccuggagcccggggacaccaucaucuacgaggccaacggcaaccugaucgcgcccugguacgccuucgcccucucccggggguucggcagcggcaucaucacguccagcgccccgauggacgagugcgacgccaagugccagacgccccagggggcgaucaacuccagccugcccuuccagaacgugcaccccgucaccaucggcgagugcccgaaguacgugcgcuccgccaagcugcggauggugaccgggcuccgcaacauccccagcauccagucccggggccuguucggggccaucgccggcuucaucgagggcggguggaccggcauggucaacgggugguacggcuaccgccugcacaacgaccaggggagcggcuacgccgcggaccagaaguccacccagaacgcccucaacggcaucaccaacaaggugaacagcgugaucgagaagaugaacacccaguucacggccgucgggaaggaguucaacaagcuggagcggcgcauggagaaccugaacaagaagguggacgacggcuuccucgacaucuggaccuacaacgccgagaugcuggugcugcucgagaacgagcggacccuggacuuccacgacuccaacgucaagagccuguacgagcgcgugaagauccagcucaagaacaacgccaaggagaucgggaacggcugcuucgaguucuaccacaagugcaacaacgagugcauggaguccguccggaacgggaccuacgacuaccccaaguacagcgaggaguccaagcugaaccgcgagaagaucgacggcgugaagcuggacagcaugggcguguaccagauccucgcgaucuacagcacggucgccuccagccuggugcugcucgugucccugggggccaucagcuucuggaugugcuccaacggcagccugcagugccggaucugcaucuga

SEQ ID NO: 67357 - RNA, 1698 nt, Artificial Sequence
  derived and/or modified sequence opt1 from hemagglutinin__InfluenzaA__ADV69090
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucuccaaggagagcugguccuacaucguggagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgucaccggggugagcgccuccugcagccacaacggcaaguccagcuucuaccgcaaccuccuguggcugacccggaagaacgggcucuaccccaaccuguccaagagcuacgccaacaacaaggagaaggaggugcugguccucuggggcgugcaccacccgcccaaccugggggaccagcgcgcccuguaccacacggagaacgccuacgugagcgucguguccagccacuacucccggcgcuucacccccgagaucgccaagcggcccaaggugcgcgaccaggagggccggaucaacuacuacuggacccuccuggagcccggcgacaccaucaucuucgaggcgaacgggaaccugaucgccccgcgcuucgccuucgcccucagccggggcuucggguccggcaucaucacgagcaacgcccccauggacgagugcgacgcgaagugccagacgccccagggcgccaucaacuccagccugcccuuccagaacguccacccggugaccaucggggagugccccaaguacgugcgcuccaccaagcugcggauggucaccggccuccgcaacauccccagcauccagucccgggggcuguucggcgccaucgccggguucaucgagggcggcuggaccgggaugguggacggcugguacggguaccaccaccagaacgagcagggcagcggguacgccgcggaccagaaguccacccagaacgccaucaacggcaucaccaacaaggugaacagcgucaucgagaagaugaacacgcaguucaccgccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgggagaagaucgacggggugaagcuggagagcaugggcgucuaccagauccuggcgaucuacagcaccguggccuccagccucgugcugcuggucucccucggcgccaucagcuucuggaugugcuccaacgggagccugcagugccgcaucugcaucuga

SEQ ID NO: 67358 - RNA, 1698 nt, Artificial Sequence
  derived and/or modified sequence opt1 from hemagglutinin__InfluenzaA__ADV69091
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugagcgccuccugcagccacaacggcaaguccagcuucuaccgcaaccugcuguggcucacgcggaagaacgggcuguaccccaaccuguccaagagcuacaccaacgacaaggagaaggaggugcucguccuguggggcgugcaccaccccuccaacaucggggaccagcgcgcccuguaccacaaggagaacgccuacgugagcgucgugagcucccacuacagccggcgcuucaccccggagaucgugaagcggcccaagguccgcgaccaggagggccggaucaacuacuacuggacccuccuggagcccggcgacacgaucaucuucgaggccaacgggaaccugaucgcgccccgcuacgccuucgcccucucccggggcuucgggagcggcaucaucaccuccaacgccccgauggacgagugcaacaccaagugccagacgccccagggcgccaucaacagcucccugcccuuccagaacgugcaccccgugaccaucggggagugcccgaaguacgucaagagcgccaagcugcgcauggugaccggccuccggaacacccccuccauccagagccgcgggcuguucggcgccaucgcgggguucaucgagggcggcuggaccgggaugguggacggcugguacggguaccaccaccagaacgagcagggcuccggguacgccgccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguuccuggacaucuggacguacaacgcggagcugcucgugcugcuggagaacgagcggacccucgacuuccacgacagcaacgucaagaaccuguacgagaaggugaagaaccagcugaagaacaacgccaaggagaucggcaacgggugcuucgaguucuaccacaagugcaacgacgagugcauggaguccgugaagaacggcaccuacgacuaccccaaguacagcgaggaguccaagcucaaccgcgagaagaucgacggggucaagcuggagagcauggagguguaccagauccuggccaucuacuccaccguggccagcagccucgucuuccuggugucccugggcgccaucugcuucuggaugugcagcaacggcucccuccagugccggaucugcaucuga

SEQ ID NO: 67359 - RNA, 1698 nt, Artificial Sequence
  derived and/or modified sequence opt1 from hemagglutinin__InfluenzaA__ADV69092
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcaacgucgccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgugagcuccuucaagcgguucgagaucuucccgaaggagagcuccuggcccaaccacaccgucaccggggugagcgccuccugcagccacaacggcaaguccagcuucuaccgcaaccugcuguggcucacggggaagaacggccuguaccccaaccuguccaagagcuacaccaacgacaaggagaaggaggugcucguccuguggggcgugcaccaccccuccaacaucggggaccagcgggcccuguaccacaaggagaacgccuacgugagcgucgugagcucccacuacagccgccgguucaccccggagaucgugaagcgccccaagguccgggaccaggagggccgcaucaacuacuacuggacccuccuggagcccggggacacgaucaucuucgaggccaacggcaaccugaucgcgccccgguacgccuucgcccucucccgcggguucggcagcggcaucaucaccuccaacgccccgauggacgagugcaacaccaagugccagacgccccagggggccaucaacagcucccugcccuuccagaacgugcaccccgugaccaucggcgagugcccgaaguacgucaagagcgccaagcugcggauggugaccgggcuccgcaacacccuguccauccagagcaagggccuguucggggccaucgcgggcuucaucgagggcggguggaccggcaugguggacgggugguacggcuaccaccaccagaacgagcagggguccggcuacgccgccgaccagaaguccacgcagaacgccaucaacggcaucaccaacaaggucaacagcgugaucgagaagaugaacacccaguucaccgccgucgggaaggaguucaacaagcucgagcggcgcauggagaaccugaacaagaagguggacgacggcuuccuggacaucuggacguacaacgcggagcuccuggugcugcucgagaacgagcggacccuggacuuccacgacagcaacgucaagaaccuguacgagaaggugaagucccagcucaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcuggaguccauggagguguaccagauccucgccaucuacagcaccguggccagcucccuggucuuccuggugagccucggcgccaucugcuucuggaugugcuccaacgggagccugcagugccggaucugcaucuga

SEQ ID NO: 67360 - RNA, 1698 nt, Artificial Sequence
  derived and/or modified sequence opt1 from hemagglutinin__InfluenzaA__ADV69093
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacgucaccgacuacgaggagcugcgcgagcagcugagcuccgugagcuccuucaagcgguucgagaucuucccgaaggagagcuccuggcccaaccacaccgugaccggggucagcuccagcugcucccacaacggcaagagcuccuucuaccgcaaccuccuguggcugacggugaagaacgggcucuaccccaaccugagcaagagcuacaccaacaagaaggagaaggaggugcugguccucuggggcgugcaccaccccuccaacaucggggaccagcgggcccuguaccacaccgagaacgccuacgugagcgucguguccagccacuacucccgccgguucaccccggagaucgccaagcgccccaaggugcggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccagccuccccuuccagaacguccaccccgugaccaucggcgagugcccgaaguacgugaaguccgccaagcugcgcauggucaccgggcugcggaacacccccagcauccagucccgcggccucuucggggccaucgcgggcuucaucgagggcggguggaccggcaugguggacgggugguacggcuaccaccaccagaacgagcaggggagcggcuacgccgccgaccagcaguccacgcagaacgccaucaacggcaucaccaacaaggucaacagcgugaucgagaagaugaacacccaguucaccgccguggggaaggaguucaacaagcuggagcggcgcauggagaaccugaacaagcgggucgacgacggcuuccucgacaucuggacguacaacgcggagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcucgaguccaugggcgucuacaacauccuggccaucuacagcaccguggccuccagccuggugcuccuggucucccugggggccaucagcuucuggaugugcuccaacggcagccuccagugccgcaucugcaucuga

SEQ ID NO: 67361 - RNA, 1698 nt, Artificial Sequence
  derived and/or modified sequence opt1 from hemagglutinin__InfluenzaA__ADV69094
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaccgugaccggggugagcuccagcugcucccacaacggcaagagcuccuucuaccgcaaccuccuguggcugacggucaagaacgggcucuaccccaaccugagcaagagcuacaccaacaagaaggagaaggaggugcuggugcucuggggcguccaccaccccuccaacaucggggaccagcgggcccuguaccacaccgagaacgccuacgugagcguggucuccagccacuacucccgccgguucaccccggagaucgccaagcgccccaaggugcggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacgccccagggggccaucaacuccagccuccccuuccagaacgugcaccccgucaccaucggcgagugcccgaaguacgugaaguccgccaagcugcgcauggugaccgggcugcggaacacccccagcauccagucccgcggccucuucggggccaucgcgggcuucaucgagggcggguggaccggcaugguccacgggugguacggcuaccaccaccagaacgagcaggggagcggcuacgccgccgagcagcaguccacgcaguacgccaucaacggcaucaccaacaaggugaacagcgucaucgagaagaugaacacccaguucaccgccguggggaaggaguucaacaagcuggagcggcgcauggagaaccugaacaagcggguggacgacggcuuccucgacaucuggacguacaacgcggagcugcugguccuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcucgaguccaugggcguguacaacauccuggccaucuacagcaccgucgccuccagccuggugcuccuggugucccugggggccaucagcuucuggaugugcuccaacggcagccuccagugccgcaucugcaucuga

SEQ ID NO: 67362 - RNA, 1698 nt, Artificial Sequence
  derived and/or modified sequence opt1 from hemagglutinin__InfluenzaA__ADV69095
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagccgcccaaccccgagaacgggaccugcuaccccggcuacuucacggacuacgaggagcugcgcgagcagcugagcuccgucagcuccuucaagcgguucgagaucuuccccaaggagagcuccuggcccaaccacaccgugaacggcgugagcuccagcugcucccacaacggcgagagcuccuucuaccgcaaccuccuguggcugaccgucaaggacgggcucuaccccaaccugagcaagagcuacaccaacaagaaggagaaggaggugcuggugcucuggggcguccaccacccguccaacaucggggaccagcgggcccuguaccacacggagaacgccuacgugagcguggucuccagccacuacucccgccgguucacccccgagaucgccaagcgccccaaggugcggaaccaggagggccgcaucaacuacuacuggacccugcucgagcccggcgacaccaucaucuucgaggccaacgggaaccugaucgccccgcgguacgccuucgagcugagcaagggcuucggguccggcaucaucacgagcaacgcgcccaugggcgagugcaacgccaagugccagacgccccagggggccaucaacuccagccuccccuuccagaacgugcacccggucaccaucggcgagugccccaaguacgugcgcuccaccaagcugcggauggugaccgggcugcgcaacacccccagcauccagucccggggccucuucggggccaucgccggcuucaucgagggcggguggaccggcauggucgacgggugguacggcuaccaccaccagaacgagcaggggagcggcuacgcggccgaccagcaguccacccagaacgccaucaacggcaucacgaacaaggugaacagcgucaucgagaagaugaacacccaguucaccgccguggggaaggaguucaacaagcuggagcgccggauggagaaccugaacaagaagaucgacgacggcuuccucgacaucuggaccuacaacgccgagcugcuggugcuccuggagaacgagcgcacgcuggacuuccacgacuccaacgucaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcucgaguccaugggcguguacaacauccuggccaucuacagcaccguggccuccagccugguccuccuggugucccugggggccaucagcuucuggaugugcuccaacggcagccuccagugccgcaucugcaucuga

SEQ ID NO: 67363 - RNA, 1698 nt, Artificial Sequence
  derived and/or modified sequence opt1 from hemagglutinin__InfluenzaA__ADV69096
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacgucaccgacuacgaggagcugcgcgagcagcugagcuccgugagcuccuucaagcgguucgagaucuucccgaaggagagcuccuggcccaaccacaccgugaccggggucagcuccagcugcucccacaacggcaagagcuccuucuaccgcaaccuccuguggcugacggugaagaacgggcucuaccccaaccugagcaagagcuacaccaacaagaaggagaaggaggugcugguccucuggggcgugcaccaccccuccaacaucggggaccagcgggcccuguaccacaccgagaacgccuacgugagcgucguguccagccacuacucccgccgguucaccccggagaucgccaagcgccccaaggugcggaaccaggagggccgcaucaacuacuacuggacgcugcucgagcccggcgacaccaucaucuucgaggccaacgggaaccugaucgcgccccgguacgccuucgagcugagcaagggcuucggguccggcaucaucaccagcaacgccccgaugggcgagugcaacgccaagugccagacccccaagggggccaucaacuccagccuccccuuccagaacguccaccccgugacgaucggcgagugcccgaaguacgugaaguccgccaagcugcgcauggucaccgggcugcggaacacccccagcauccagucccgcggccucuucggggccaucgcgggcuucaucgagggcggguggaccggcaugguggacgggugguacggcuaccaccaccagaacgagcaggggagcggcuacgccgccgaccagcaguccacgcagaacgccaucaacggcaucaccaacaaggucaacagcgugaucgagaagaugaacacccaguucaccgccguggggaaggaguucaacaagcuggagcggcgcauggagaaccugaacaagaaggucgacgacggcuuccucgacaucuggacguacaacgcggagcugcuggugcuccuggagaacgagcggacccuggacuuccacgaguccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagagcaagcugaaccgcgagaagaucgacggcgugaagcucgaguccaugggcgucuacaacauccuggccaucuacagcaccguggccuccagccuggugcuccuggucucccugggggccaucagcuucuggaugugcuccaacggcagccuccagugccggaucugcaucuga

SEQ ID NO: 67364 - RNA, 1698 nt, Artificial Sequence
  derived and/or modified sequence opt1 from hemagglutinin__InfluenzaA__ADV69097
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucgagacccccaaccccggcaacggcgccugcuaccccggguacuucgccgacuacgaggagcugcgcgagcagcucuccagcguguccagcuucgagcgguucgagaucuucccgaaggaguccagcugguccaaccacaacgugaacggcgucagcgccuccugcagccacaacgggaaguccagcuucuaccgcaaccugcuguggcucacgggcaagaacgggcuguaccccacccugaccaaguccuacgccaacgacaaggagaaggaggugcucauccuguggggcgugcaccaccccagcaacaucggcgaccagcggacccuguaccacacggagaacgccuacgucagcgugauguccagccacuacucccgccgguucacccccgagaucagcaagcgcccgaaggugcgggaccaggaggggcgcaucaacuacuacuggacccuccuggagcccggcgacaccaucaucuucgaggccaacgggaaccugaucgcgcccugguacgccuucgcccucucccggggcuucggcagcgggaucaucacguccaacgcccccauggacgagugcgacgccaagugccagaccccgcagggcgcgaucaacagcucccugcccuuccagaacauccaccccgucaccaucggggagugccccaaguacgugcgcagcgccaagcugcggauggugaccggccuccgcaacacgccguccauccagagccgggggcuguucggcgccaucgccggcuucaucgagggcggguggaccgggauggucgacggcugguacggguaccaccaccagaacgagcagggcuccggcuacgccgcggaccaggagagcacccagaacgccaucaacgagaucaccaacaaggagaacuccgugaucgagaagaugaacacgcaguucaccagcguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagagccuguacgagaaggugaagauccagcugaagaacaacgccaaggagaucgggaacggcugcuucgaguucuaccacaagugcaacaacgagugcauggaguccgugcggaacgggacguacgacuaccccaaguacagcgaggagagcaagcucaaccgcgagaagaucgacggcgucaagcuggacuccaugggcguguaccagauccuggccaucuacagcaccguggcguccagccucguccugcuggugucccucggggccaucagcuucuggaugugcuccaacggcagccugcagugccggaucugcaucuga

SEQ ID NO: 67365 - RNA, 1698 nt, Artificial Sequence
  derived and/or modified sequence opt1 from hemagglutinin__InfluenzaA__ADV69098
augaaggugaagcugaucguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaccgugaccggggugagcuccagcugcucccacaacggcaacagcuccuucuaccgcaaccuccuguggcugacggucaagaacgggcucuaccccaaccugagcaagagcuacaccaacaagaaggagaaggaggugcuggugcucuggggcguccaccaccccuccaacaucgaggaccagcgggcccuguaccacaccgagaacgccuacgugagcguggucuccagccacuacucccgccgguucaacccggagaucgccaagcgccccaaggugcggaaccaggaggggcgcaucaacuacuacuggacccugcucgagcccggcgacacgaucaucuucgaggccaacggcaaccugaucgcgccccgguacgccuucgagcugagcaagggguucggcuccgggaucaucaccagcaacgccccgaugggcgagugcaacgccaagugccagacgccccagggcgccaucaacuccaaccuccccuuccagaacgugcaccccgucaccaucggggagugcccgaaguacgugcgcagcgccaagcugcggauggugaccggccugcgcaacacccccuccauccagagccggggccucuucggggccaucgcgggguucaucgagggcggcuggaccgggauggucgacggcugguacggguaccaccaccacaacgagcagggcuccggguacgccgccaaccagaaguccacccccaacgccaucaacggcaucacgaacaaggugaacagcgucaucgagaagaugaacacccaguucaccgccgugggcaaggaguucaacaagcuggagcgccggauggagaaccugaacaagaagguggacgacggguuccucgacaucuggaccuacaacgcggagcugcugguccuccuggagaacgagcgcacgcuggacuuccacgacagcaacgugaagaaccucuacgagaaggugcggucccagcugaagaacaacgccaaggagaucggcaacgggugcuucgaguucuaccacaagugcaacgacgagugcauggagagcgucaagaacggcaccuacgacuaccccaaguacuccgaggagagcaagcugaaccgcgagaagaucgacggggugaagcucgagagcaugggcguguacaacauccuggccaucuacuccaccgucgccagcucccuggugcuccuggugagccugggcgccaucuccuucuggaugugcagcaacgggucccuccagugccggaucugcaucuga

SEQ ID NO: 67366 - RNA, 1698 nt, Artificial Sequence
  derived and/or modified sequence opt1 from hemagglutinin__InfluenzaA__ADV69099
augaaggugaagcugaucguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaccgugaccggggugagcuccagcugcucccacaacggcaacagcuccuucuaccgcaaccuccuguggcugacggucaagaacgggcucuaccccaaccugagcaagagcuacaccaacaagaaggagaaggaggugcuggugcucuggggcguccaccaccccuccaacaucgaggaccagcgggcccuguaccacaccgagaacgccuacgugagcguggucuccagccacuacucccgccgguucaacccggagaucgccaagcgccccaaggugcggaaccaggaggggcgcaucaacuacuacuggacccugcucgagcccggcgacacgaucaucuucgaggccaacggcaaccugaucgcgccccgguacgccuucgagcugagcaagggguucggcuccgggaucaucaccagcaacgccccgaugggcgagugcaacgccaagugccagacgccccagggcgccaucaacuccaaccuccccuuccagaacgugcaccccgucaccaucggggagugcccgaaguacgugcgcagcgccaagcugcggauggugaccggccugcgcaacacccccuccauccagagccggggccucuucggggccaucgcgggguucaucgagggcggcuggaccgggauggucaacggcugguacggguaccaccaccacaacgagcagggcuccggguacgccgccaaccagcagagcccgcccaacgccaucaacggcaucaccaacaaggugaacuccgucaucgagaagaugaacacgcaguucaccgccgugggcaaggaguucaacaagcuggagcgccggauggagaaccugaacaagaagguggacgacggguuccucgacaucuggaccuacaacgcggagcugcugguccuccuggagaacgagcgcacccuggacuuccacgacagcaacgugaagaaccucuacgagaaggugcggucccagcugaagaacaacgccaaggagaucggcaacgggugcuucgaguucuaccacaagugcaacgacgagugcauggagagcgucaagaacggcacguacgacuaccccaaguacuccgaggagagcaagcugaaccgcgagaagaucgacggggugaagcucgagagcaugggcguguacaacauccuggccaucuacuccaccgucgccagcucccuggugcuccuggugagccugggcgccaucuccuucuggaugugcagcaacgggucccuccagugccggaucugcaucuga

SEQ ID NO: 67367 - RNA, 1698 nt, Artificial Sequence
  derived and/or modified sequence opt1 from hemagglutinin__InfluenzaA__ADV69100
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggagcuacaucgucgagacccccaagcccgagaacggcacgugcuaccccggcgaguucgccgacuacgaggagcugcgcgagcagcugagcuccgugagcuccuucgagcgguucgagaucuucccgaaggagagcuccuggcccaaccacaccgccgccggggugagcgccuccugcagccacaacggcgagcgcuccuucuacaagaaccucaucuggcugaccgucaagaacgggcuguaccccaaccucagcaaguccuacaagaacgacaaggagaaggaggugcugauccuguggggcgugcaccacccgcccaacaucgagaaccagcggacccucuaccacacggagaacaccuacgucagcguggugagcucccacuacagcgggcgcuucacccccgagaucaccaagcggcccaagguccgcgaccaggagggccggaucaacuacuacuggacgcugcuggagcccggcgacaccaucaucuucgaggccaacgggaaccucaucgccccgugguacgcguucacccugucccgcggccuggggagcggcaucgugaccuccaacgcccccauggacaagugcgacgccaagugccagacgccccacggcgccaucaacagcucccuccccuuccagaacgugcacccggucaccaucggggagugccccaaguacgugcggagcgccaagcugcgcauggugaccggccugcggaacauccccuccauccagagccgcggccucuucggggcgaucgccggguucaucgagggcggcuggaccgggauggucgacggcugguacggguaccaccaccagaacgagcagggcuccggguacgccgccgaccaggagagcacgcagaacgccaucaacggcaucaccaacaaggugaacuccgugaucgagaagaugaacacccaguucaccgcggucggcaaggaguucaacaagcuggagcggcgcauggagaaccugaacaagaagguggacgacggguuccucgacaucuggacguacaacgccgagcugcugguccuccuggagaacgagcggacccuggacuuccacgacagcaacgugaagucccucuacgagaaggucaagagccagcugaagaacaacgccaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcucgacagcaugggcguguaccggauccuggccaucuacagcaccgucgccuccagccuggugcuccuggugucccugggcgcgaucagcuucuggaugugcuccaacgggagccuccagugccgcaucugcaucuga

SEQ ID NO: 67368 - RNA, 1698 nt, Artificial Sequence
  derived and/or modified sequence opt1 from hemagglutinin__InfluenzaA__ADV69101
augaaggugaagcugcucauccuguucugcaccuucaccgccacguacgccgacaccaucugcaucggcuaccacgcgaacaacagcaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagagccugaucuccaagaaguccuggagcuacaucgucgagacccccaaccccgagaacggcgccugcuaccccggcgaguucgccgacuacgaggagcuccgcgagcagcugagcuccgugagcuccuucgagcgguucgagaucuucccgaaggagagcuccuggcccaaccacacggccaccggggugagcgccuccugcagccacaacggcgagcgcuccuucuaccggaaccugaucuggcucaccgucaagaacgggcuguaccccaaccugagcaaguccuacgagaacgacaaggagaaggaggugcucauccuguggggcgugcaccacccgcccaacaucgagaaccagcgcacccuguaccacacggagaacgccuacgucagcguggugagcucccacuacagcgggcgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucacccucucccggggccuggggagcggcaucaucaccuccaacgcccccauggacgagugcgacagcaagugccagacgccccagggcgccaucaacuccagccugcccuuccagaacgugcacccggugaccaucggggagugccccaaguacguccgcuccgccaagcuccggauggugaccggccugcgcaacauccccagcauccagucccgggggcuguucggcgcgaucgccggguucaucgagggcggcuggaccgggaugguggacggcugguacggguaccaccaccagaacgagcagggcagcggguacgccgccgaccaggaguccacccagaacgccaucaacggcaucacgaacaaggucaacagcgugaucgagaagaugaacccccaguucaccgcggugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacuccaacgucaagagccuguacgagaaggugaagucccagcucaagaacaacgccaaggagaucggcaacgggugcuucgaguucuaccacaagugcaacaacgagugcauggagagcgugaagaacggcacguacgacuacccgaaguacuccgaggagagcaagcugaaccgggagaagaucgacggggucaagcuggacagcaugggcguguaccgcauccucgccaucuacuccaccguggccagcucccugguccugcucgugagccugggcgcgaucuccuucuggaugugcagcaacgggucccugcagugccggaucugcaucuga

SEQ ID NO: 67369 - RNA, 1698 nt, Artificial Sequence
  derived and/or modified sequence opt1 from hemagglutinin__InfluenzaA__ADV69102
augaaggugaagcugcucauccuguucugcaccuucaccgccacguacgccgacaccaucugcaucggcuaccacgcgaacaacagcaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagagccugaucuccaagaaguccuggagcuacaucgucgagacccccaaccccgagaacggcgccugcuaccccggcgaguucgccgacuacgaggagcuccgcgagcagcugagcuccgugagcuccuucgagcgguucgagaucuucccgaaggagagcuccuggcccaaccacacggccaccggggugagcgccuccugcagccacaacggcgagcgcuccuucuaccggaaccugaucuggcucaccgucaagaacgggcuguaccccaaccugagcaaguccuacgagaacgacaaggagaaggaggugcucauccuguggggcgugcaccacccgcccaacaucgagaaccagcgcacccuguaccacacggagaacgccuacgucagcguggugagcucccacuacagcgggcgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucacccucuccaccggccuggggagcggcaucaucaccuccaacgcccccauggacgagugcgacagcaagugccagacgccccagggcgccaucaacuccagccugcccuuccagaacgugcacccggugaccaucggggagugccccaaguacguccgguccgccaagcuccgcauggugaccggccugcggaacauccccagcauccagucccgcgggcuguucggcgcgaucgccggguucaucgagggcggcuggaccgggaugguggacggcugguacggguaccaccaccagaacgagcagggcagcggguacgccgccgaccaggaguccacgcagaacgccaucaacggcaucaccaacaaggucaacagcgugaucgagaagaugaacacccaguucaccgcggugggcaaggaguucaacaagcucgagcggcgcauggagaaccugaacaagaaggucgacgacggguuccuggacaucuggacguacaacgccgagcuccuggugcugcucgagaacgagcggacccuggacuuccacgacuccaacgucaagagccuguacgagaaggugaagucccagcucaagaacaacgccaaggagaucggcaacgggugcuucgaguucuaccacaagugcaacaacgagugcauggagagcgugaagaacggcaccuacgacuaccccaaguacuccgaggagagcaagcugaaccgcgagaagaucgacggggucaagcuggacagcaugggcguguaccggauccucgccaucuacuccaccguggccagcucccugguccugcucgugagccugggcgcgaucuccuucuggaugugcagcaacgggucccugcagugccgcaucugcaucuga

SEQ ID NO: 67370 - RNA, 1698 nt, Artificial Sequence
  derived and/or modified sequence opt1 from hemagglutinin__InfluenzaA__ADV69103
augaaggugaagcugaugguccuccugugcaccuucaccgccacguacgccgacaccaucugcgugggcuaccacgcgaacaacagcaccgacaccguggacacgguccuggagaagaacgugaccgugacccacuccgucaaccuccuggaggacagccacaacgggaagcugugccuccugaagggcaucgcgccccugcagcucggguccugcagcguggccggcuggauccuggggaacccggagugcgagcugcucaucuccaaggagagcugguccuacaucguggagacccccaaccccgagaacggcacgugcuaccccggcuacuucaccgacuacgaggagcugcgcgagcagcugagcuccgucagcuccuucaagcgguucgagaucuucccgaaggagagcuccuggcccaaccacaacgugaccggggugagcuccagcugcucccacaacggcaagagcuccuucuaccgcaaccuccuguggcugaccgucaagaacgggcucuaccccaaccugagcaagagcuacacgaacaagaaggagaaggaggugcuggugcucuggggcguccaccaccccuccaacaucggggaccagcgggcccuguaccacaccgagaacgccuacgugagcguggucuccagccacuacucccgccgguucaccccggagaucgccaagcgccccaaggugcggaaccaggagggccgcaucaacuacuacuggacccugcucgagcccggcgacacgaucaucuucgaggccaacgggaaccugaucgcgccccgguacgccuucgagcugagcaagggcuucggguccggcaucaucaccagcaacgccccgaucggcgagugcaacgccaagugccagacgccccagggggccaucaacuccagccuccccuuccagaacgugaaccccgucaccaucggcgagugcccgaaguacgugaaguccgccaagcugcgcauggugaccgggcugcggaacacccccagcauccagucccgcggccucuucggggccaucgcgggcuucaucgagggcggguggaccggcauggucgacgggugguacggcuaccaccaccagaacgagcaggggagcggcuacgccgccgaccagcaguccacccagaacgccaucaacggcaucacgaacaaggugaacagcgucaucgagaagaugaacacccaguucaccgccguggggaaggaguucaacaagcuggagcggcgcauggagaaccugaacaagaagguggacgacggcuuccucgacaucuggaccuacaacgcggagcugcugguccuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagagcaagcugaaccgcgagaagaucgacggcgugaagcucgaguccaugggcguguacaacauccuggccaucuacagcaccgucgccuccagccuggugcuccuggugucccugggggccaucagcuucuggaugugcuccaacggcagccuccagugccggaucugcaucuga

SEQ ID NO: 67371 - RNA, 1698 nt, Artificial Sequence
  derived and/or modified sequence opt1 from hemagglutinin__InfluenzaA__ADV69104
augaaggugaagcugcucauccuguucugcaccuucaccgccacguacgccgacaccaucugcaucggcuaccacgcgaacaacagcaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagagccugaucuccaagaaguccuggagcuacaucgucgagacccccaaccccgagaacggcgccugcuaccccggcgaguucgccgacuacgaggagcuccgcgagcagcugagcuccgugagcuccuucgagcgguucgagaucuucccgaaggagagcuccuggcccaaccacacggccaccggggugagcgccuccugcagccacaacggcgagcgcuccuucuaccggaaccugaucuggcucaccgucaagaacgggcuguaccccaaccugagcaaguccuacgagaacgacaaggagaaggaggugcucauccuguggggcgugcaccacccgcccaacaucgagaaccagcgcacccuguaccacacggagaacgccuacgucagcguggugagcucccacuacagcgggcgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucacccucucccggggccuggggagcggcaucaucaccuccaacgcccccauggacgagugcgacagcaagugccagacgccccagggcgccaucaacuccagccugcccuuccagaacgugcacccggugaccaucggggagugccccaaguacguccgcuccgccaagcuccggauggugaccggccugcgcaacauccccagcauccagucccgggggcuguucggcgcgaucgccggguucaucgagggcggcuggaccgggaugguggacggcugguacggguaccaccaccagaacgagcagggcagcggguacgccgccgaccaggaguccacccagaacgccaucaacggcaucacgaacaaggucaacagcgugaucgagaagaugaacacccaguucaccgcggugggcaaggaguucaacaagcucgagcgccggauggagaaccugaacaagaaggucgacgacggguuccuggacaucuggaccuacaacgccgagcuccuggugcugcucgagaacgagcgcacgcuggacuuccacgacuccaacgucaagagccuguacgagaaggugaagucccagcucaagaacaacgccaaggagaucggcaacgggugcuucgaguucuaccacaagugcaacaacgagugcauggagagcgugaagaacggcaccuacgacuaccccaaguacuccgaggagagcaagcugaaccgggagaagaucgacggggucaagcuggacagcaugggcguguaccgcauccucgccaucuacuccaccguggccagcucccugguccugcucgugagccugggcgcgaucuccuucuggaugugcagcaacgggucccugcagugccggaucugcaucuga

SEQ ID NO: 67372 - RNA, 1698 nt, Artificial Sequence
  derived and/or modified sequence opt1 from hemagglutinin__InfluenzaA__ADV69105
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggagcuacaucgucgagacccccaaccccgagaacggcgccugcuaccccggcgaguucgccgacuacgaggagcugcgcgagcagcugagcuccgugagcuccuucgagcgguucgagaucuucccgaaggagagcuccuggcccaaccacacggccgccggggugagcgccuccugcagccacaacggcgagcgcuccuucuaccggaaccucaucuggcugaccgucaagaacgggcuguaccccaaccucagcaaguccuacaagaacgacaaggagaaggaggugcugaucaucuggggcgugcaccacccgcccaacaucgagaaccagcgcacccuguaccacaccgagaacgccuacgucagcguggugagcucccacuacagcgggcgguucacgcccgagaucaccaagcgccccaagguccgggaccaggagggccgcaucaacuacuacuggacccuccuggagcccggcgacaccaucaucuucgaggcgaacgggaaccugaucgccccgugguacgccuucacgcucucccggggccuggggagcggcaucaucaccuccaacgcccccauggacgagugcgacgccaagugccagacgccccagggcgcgaucaacagcucccugcccuuccagaacgugcacccggugaccaucggggagugccccaaguacguccgcagcgccaagcuccggauggugaccggccugcgcaacauccccuccauccagagccgggggcuguucggcgccaucgccggguucaucgagggcggcuggaccgggaugguggacggcugguacggguaccaccaccagaacgagcagggcuccggguacgccgcggaccaggagagcacccagaacgccaucaacggcaucaccaacaaggucaacuccgugaucgagaagaugaacacgcaguucaccgccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacagcaacgucaagucccuguacgagaaggucaagagccagcucaagaacaacgccaaggagaucggcaacgggugcuucgaguucuaccacaagugcaacaacgagugcauggaguccgugaagaacggcacguacgacuaccccaaguacagcgaggaguccaagcugaaccgggagaagaucgacggggugaagcuggacagcaugggcguguaccgcauccucgcgaucuacagcaccguggccuccagccugguccugcucgugucccugggcgccaucagcuucuggaugugcuccaacgggagccugcagugccggaucugcaucuga

SEQ ID NO: 67373 - RNA, 1698 nt, Artificial Sequence
  derived and/or modified sequence opt1 from hemagglutinin__InfluenzaA__ADV69106
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggagcuacaucgucgagacccccaaccccggcaacggcgccugcuaccccggguacuucgccgacuacgaggagcugcgcgagcagcugagcuccgugagcuccuucgagcgguucgagauguucccgaaggagagcuccuggcccaaccacaacgugaacggcgucagcgccuccugcagccacaacgggaaguccagcuucuaccgcaaccuccuguggcugacgcggaagaacggccucuaccccaaccugaccaaguccuacgccaacaacaacgacaaggaggugcugauccucuggggcgugcaccaccccagcaacaucggggaccagcgcacccuguaccacaccgagaacgccuacgucagcgugauguccagccacuacucccggcgcuucacgccggagaucaccaagcggcccaaggugcgcgaccaggagggccggaucaacuacuacuggacccugcucgagcccggggacaccaucaucuucgaggccaacggcaaccugaucgcgcccugguacgccuucgcccugagccgcuccuucgggagcggcaucaucacguccagcgccccgauggacgagugcgacgccaagugccagacgccccagggcgcgaucaacuccagccuccccuuccagaacguccaccccgugaccaucggggagugcccgaaguacgugcgguccgccaagcugaagauggucaccggccugcgcaacauccccagcauccagucccggggccucuucggggccaucgccggguucaucgagggcggcuggaccgggaugguggacggcugguacggguaccaccaccagaacgagcagggcagcggguacgccgcggaccaggaguccacccagaacgccaucaacggcaucaccaacaaggugaacagcgucaucgagaagaugaacacccaguucacggccgugggcaaggaguucaacaagcuggagaagcgcauggagaaccugaacaagaagguggacgacggguuccucgacaucuggaccuacaacgccgagcugcugguccuccuggagaacgagcggacccuggacuuccacgacuccaacgucaagagccucuacgagaaggugaagauccagcugaagaacaacgccaaggagaucggcaacgggugcuucgaguucuaccacaagugcaacaacgagugcauggaguccgugcgcaacggcaccuacgacuaccccaaguacagcgaggagagcaagcugaaccgggagaagaucgacggggugaagcucgacuccaugggcgucuaccagauccuggcgaucuacagcacgguggccuccagccuggugcuccuggucucccugggcgccaucagcuucuggaugugcuccaacgggagccuccagugccgcaucugcaucuga

SEQ ID NO: 67374 - RNA, 1698 nt, Artificial Sequence
  derived and/or modified sequence opt1 from hemagglutinin__InfluenzaA__ADV69107
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaacagcgacaacggcgccugcuaccccggccaguucacggacuacgaggagcugcgcgagcagcuguccagcguguccagcuucgagcgguucgagaucuuccccaaggaguccagcuggccgaaccacaccgugaccggggucuccgccagcugcucccacaacggcgagcgcagcuucuaccggaaccucaucuggcugaccgugaagaacgggcuguaccccaaccucuccaagagcuacgagaacgacaaggagaaggaggugcugauccuguggggcguccaccacccgcccaacaucggggaccagcgcacgcucuaccacaccgagaacgccuacaucagcgugguguccagccacuacuccggccgguucacccccgagaucaccaagcgccccaagguccgggaccaggagggccgcaucaacuacuacuggacgcugcuggagcccggggacaccaucaucuucgaggccaacggcaaccucaucgcccccugguacgccuucgcgcugagccgggggcugggcuccggcaucaucaccagcaacgccccgauggacaagugcgacgccaagugccagacgccccagggggccaucaacuccagccuccccuuccagaacgugcaccccgugaccaucggcgagugcccgaaguacguccgcuccaccaagcugcggauggugaccgggcugcgcaacauccccagcauccagucccggggccucuucggggccaucgcgggcuucaucgagggcggguggaccggcaugguggacgggugguacggcuaccaccaccagaacgagcaggggagcggcuacgccgccgaccaggaguccacgcagaacgccaucaacggcaucaccaacaaggucaacagcgugaucgagaagaugaacacccaguucaccgccguggggaaggaguucaacaagcuggagcgccggauggagaaccugaacaagaaggucgacgacggcuuccucgacaucuggacguacaacgcggagcugcuggugcuccuggagaacgagcgcacccuggacuuccacgacuccaacgucaagagccucuacgagaaggugaagucccagcugaagaacaacgccaaggagaucgggaacggcugcuucgaguucuaccacaagugcaacaacgagugcauggagagcgugcggaacgggaccuacgacuaccccaaguacuccgaggagagcaagcugaaccgcgagaagaucgacggcgucaagcucgacagcaugggcguguaccggauccuggccaucuacuccaccgccgccagcucccuggugcuccuggucagccugggggcgaucuccuucuggaugugcagcaacggcucccuccagugccgcaucugcaucuga

SEQ ID NO: 67375 - RNA, 1698 nt, Artificial Sequence
  derived and/or modified sequence opt1 from hemagglutinin__InfluenzaA__ADV69108
augaaggugaagcugcucguccugcugugcaccuucaccgccacguacgccgacaccaucugcgugggcuaccacgcgaacaacagcaccgacaccguggacacgguccucgagaagaacgugaccgugacccacuccgucaaccugcuggaggacagccacaacgggaagcucugccugcugaagggcaucgcgccccuccagcugggguccugcagcguggccggcuggauccuggggaacccggagugcgagcuccugaucuccaaggagagcugguccuacaucguggagacccccaaccccgagaacggcacgugcuaccccggcuacuucaccgacuacgaggagcugcgcgagcagcucagcuccgucagcuccuucaagcgguucgagaucuucccgaaggagagcuccuggcccaaccacaccgugaccggggugagcuccagcugcucccacaacggcaagagcuccuucuaccgcaaccugcuguggcucacgaugaagaacgggcuguaccccaaccugagcaagagcuacaccaacaagaaggagaaggagguccucgugcuguggggcgugcaccaccccuccaacaucggggaccagcgggcccuguaccacaccgagaacgccuacgucagcgugguguccagccacuacucccgccgguucaccccggagaucgccaagcgccccaagguccggaaccaggagggccgcaucaacuacuacuggacgcuccuggagcccgaggacaccaucaucuucgaggccaacggcaaccugaucgcgccccgguacgccuucgagcucagcaagggguucggcuccgggaucaucaccagcaacgccccgaugggcgagugcaacgccaagugccagacgccccagggcgccaucaacuccagccugcccuuccagaacgugcaccccgugaccaucggggagugcccgaaguacguccgcuccagcaagcugcggauggugaccggccuccgcaacacccccuccauccagagccgggggcuguucggcgccaucgccggguucaucgagggcggcuggaccgggaugguggacggcugguacggguaccaccaccagaacgagcagggcuccggguacgcggccgaccagcagagcacgcagaacgccaucaacggcaucaccaacaaggucaacuccgugaucgagaagaugaacacccaguucaccgccgucggcaaggaguucaacaagcuggagcgccggauggagaaccucaacaagaagaucgacgacggguuccuggacaucuggacguacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacagcgaggaguccaagcucaaccgggagaagaucgacggggugaagcuggagagcaugggcgucuacaacauccuggccaucuacuccaccguggccagcucccucgugcugcuggucagccucggcgccaucuccuucuggaugugcagcaacgggucccugcagugccgcaucugcaucuga

SEQ ID NO: 67376 - RNA, 1698 nt, Artificial Sequence
  derived and/or modified sequence opt1 from hemagglutinin__InfluenzaA__ADV69109
augaaggugaagcugcucauccugcugugcaccuucaaggccaccuacgccgacacgaucugcaucggcuaccacgcgaacaacagcaccgagaccgucgacaccgugcucgagaagaacgugacggucacccacuccgugaaccugcuggaggacagccacaacgggaagcucugccugcugaagggcaucgcgccccuccagcuggggaacugcuccguggccggcuggauccuggggaacccggagugcgagagccucaucuccaagaaguccuggagcuacaucgucgagacccccaaccccgagaacggcgccugcuaccccggcgaguucgccgacuacgaggagcugcgcgagcagcugagcuccgugagcuccuucgagcgguucgagaucuucccgaaggagagcuccuggcccaaccacaccgccacgggggugagcgccuccugcagccacaacggcgagcgcuccuucuaccggaaccucaucuggcugaccgucaagaacgggcuguaccccaaccucagcaaguccuacgagaacgacaagaagaaggaggugcugauccuguggggcgugcaccacccgcccaacaucgagaaccagcgcacccucuaccacaccgagaacgccuacgucagcguggugagcucccacuacagcgggcgguucacgcccgagaucaccaagcgccccaagguccgggaccaggagggccgcaucaacuacuacuggacccugcuggagcccggcgacaccaucaucuucgaggccaacgggaaccucaucgcgccgugguacgccuucacgcugucccggggccuggggagcggcaucaucaccuccaacgcccccauggacgagugcgacgccaagugccagacccccaagggcgccaucaacagcucccuccccuuccagaacgugcacccggugaccaucggggagugccccaaguacguccgcagcgcgaagcugcggauggugacgggccugcgcaacauccccuccauccagagccggggccucuucggggccaucgccggguucaucgagggcggcuggaccgggaugguggacggcugguacggguaccaccaccagaacgagcagggcuccggguacgccgccgaccaggagagcacccagaacgcgaucaacggcaucaccaacaaggucaacuccgugaucgagaagaugaacacgcaguucaccgccgugggcaaggaguucaacaagcuggagcgccggauggagaaccugaacaagaaggucgacgacggguuccucgacaucuggaccuacaacgccgagcugcuggugcuccuggagaacgagcgcacccuggacuuccacgacagcaacgucaagucccucuacgagaaggucaagagccagcugaagaacaacgccaaggagaucggcaacgggugcuucgaguucuaccacaagugcaacaacgagugcauggaguccgugaagaacggcacguacgacuaccccaaguacagcgaggaguccaagcugaaccgggagaagaucgacggggugaagcucgacagcaugggcguguaccgcauccuggccaucuacagcaccguggcguccagccugguccuccuggugucccugggcgccaucagcuucuggaugugcuccaacgggagccuccagugccggaucugcaucuga

SEQ ID NO: 67377 - RNA, 1701 nt, Artificial Sequence
  derived and/or modified sequence opt1 from hemagglutinin__InfluenzaA__ADV76579
augaagaccaucaucgcccugagcuacauccucugccugguguucgcccagaagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 67378 - RNA, 1701 nt, Artificial Sequence; identical to SEQ ID NO: 64596
  derived and/or modified sequence opt1 from hemagglutinin__InfluenzaA__ADV76587

SEQ ID NO: 67379 - RNA, 1701 nt, Artificial Sequence; identical to SEQ ID NO: 64596
  derived and/or modified sequence opt1 from hemagglutinin__InfluenzaA__ADV76598

SEQ ID NO: 67380 - RNA, 1701 nt, Artificial Sequence; identical to SEQ ID NO: 64419
  derived and/or modified sequence opt1 from hemagglutinin__InfluenzaA__ADV76609

SEQ ID NO: 67381 - RNA, 1701 nt, Artificial Sequence; identical to SEQ ID NO: 64596
  derived and/or modified sequence opt1 from hemagglutinin__InfluenzaA__ADV76620

SEQ ID NO: 67382 - RNA, 1701 nt, Artificial Sequence
  derived and/or modified sequence opt1 from hemagglutinin__InfluenzaA__ADV76631
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccauggugaagcccggcgacauccugcucaucaacuccaccgggaaccugaucgccccgcggggcuacuucaagauccgcagcgggaaguccagcaucaugcgguccgacacgcccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacagcgaggggcggggccaggccgccgaccugaaguccacccaggccgcgaucgaccagaucaacgggaagcugaaccgccucaucggcaaggccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67383 - RNA, 1701 nt, Artificial Sequence; identical to SEQ ID NO: 66600
  derived and/or modified sequence opt1 from hemagglutinin__InfluenzaA__ADV76642

SEQ ID NO: 67384 - RNA, 1701 nt, Artificial Sequence; identical to SEQ ID NO: 66604
  derived and/or modified sequence opt1 from hemagglutinin__InfluenzaA__ADV76664

SEQ ID NO: 67385 - RNA, 1701 nt, Artificial Sequence
  derived and/or modified sequence opt1 from hemagglutinin__InfluenzaA__ADV76673
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgagagccgccccugggugcggggccuguccagccgcaucuccaucuacuggaccaucgucaaccccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaaggcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 67386 - RNA, 1701 nt, Artificial Sequence
  derived and/or modified sequence opt1 from hemagglutinin__InfluenzaA__ADV76682
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcggggaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 67387 - RNA, 1701 nt, Artificial Sequence; identical to SEQ ID NO: 64621
  derived and/or modified sequence opt1 from hemagglutinin__InfluenzaA__ADV76694

SEQ ID NO: 67388 - RNA, 1701 nt, Artificial Sequence; identical to SEQ ID NO: 64419
  derived and/or modified sequence opt1 from hemagglutinin__InfluenzaA__ADV76705

SEQ ID NO: 67389 - RNA, 1701 nt, Artificial Sequence; identical to SEQ ID NO: 64621
  derived and/or modified sequence opt1 from hemagglutinin__InfluenzaA__ADV76716

SEQ ID NO: 67390 - RNA, 1701 nt, Artificial Sequence
  derived and/or modified sequence opt1 from hemagglutinin__InfluenzaA__ADV76727
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaaguccagcgccugcauccgccgguccaagaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67391 - RNA, 1701 nt, Artificial Sequence
  derived and/or modified sequence opt1 from hemagglutinin__InfluenzaA__ADV91009
augaaggccauccuggccgugcuccuguacaccuucgcgaccgccaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucguggagacccccuccagcgacaacggcacgugcuaccccggcgacuucaucgacuacgaggagcuccgggagcagcuguccagcgucuccagcuucgagcgcuucgagaucuuccccaagaccuccagcuggccgaaccacgacuccaacaagggggugaccgccgccugcccccacgcgggcgccaagagcuucuacaagaaccugaucuggcucgugaagaaggggaacuccuaccccaagcugagcaaguccuacaucaacgacaagggcaagaagguccuggugcucugggggauccaccaccccagcaccagcgccgaccagcagucccuguaccagaacgccgacgccuacguguucgucggcacgagccgguacuccaagaaguucaagccggagaucgcgauccgccccaaggugcgggaccaggagggccgcaugaacuacuacuggacccugguggagcccggggacaagaucaccuucgaggccaccggcaaccucgucgugccccgguacgccuucgccauggagcgcaacgccgggagcggcaucaucaucuccgacacgccggugcacgacugcaacacgaccugccagacccccaagggcgcgaucaacaccagccugcccuuccagaacauccaccccaucaccaucgggaagugcccgaaguacgucgaguccaccaagcugcggcucgccaccggccugcgcaacgugcccagcauccagucccgggggcuguucggcgccaucgccggguucaucgagggcggcuggacggggaugguggacggcugguacggguaccaccaccagaacgagcagggcagcggguacgccgcggaccucaaguccacccagaacgccaucgacaagaucaccaacaaggucaacagcgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgucaagcucgaguccacccgcaucuaccagauccuggccaucuacagcaccguggccuccagccuggugcucgucgugagccugggggccaucuccuucuggaugugcagcaacggcucccugcagugccggaucugcaucuga

SEQ ID NO: 67392 - RNA, 1701 nt, Artificial Sequence
  derived and/or modified sequence opt1 from hemagglutinin__InfluenzaA__ADV91010
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaccgacuacgaggagcuccgggagcagcugagcuccgugagcuccuucgagcgcuucgagaucuuccccaagaccagcuccuggcccaaccacgacagcaacaagggggucaccacggccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccaccagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacaccccggugcacgacugcaacaccacgugccagacccccaagggcgccaucaacaccagccugcccuuccagaacauccaccccaucaccaucgggaagugcccgaaguacgugaaguccacgaagcugcggcucgccaccggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 67393 - RNA, 1701 nt, Artificial Sequence
  derived and/or modified sequence opt1 from hemagglutinin__InfluenzaA__ADW01407
auggaggccaagcuguucguccucuucugcgccuucaccgcgcugaaggccgacaccaucugcgugggcuaccacgccaacaacagcacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacagcugguccuacaucaucgagaccagcaacuccaagaacggcgcgugcuaccccggcgaguucgccgacuacgaggagcugaaggagcagcugagcaccgucuccagcuucgagcgcuucgagaucuuccccaaggccacguccuggcccaaccacgacaccacccgggggaccacgguggccugcagccacuccggcgcgaacagcuucuaccgcaaccuccuguggaucgugaagaaggggaacuccuacccgaagcugagcaaguccuacaccaacaacaagggcaaggagguccucgugaucuggggcgugcaccacccgcccaccgacagcgaccagcagacccuguaccagaacaaccacacguacgucuccguggggagcagcaaguacuacaagcggcugacccccgagaucguggcccgccccaagguccgggagcaggccggccgcaugaacuacuacuggacccuccuggaccagggggacaccaucacguucgaggccaccggcaaccugaucgcccccuggcacgcguucgcccucaagaagggguccagcuccggcaucaugcggagcgacgcccaggugcacaacugcaccaccaagugccagacgccccacggcgcccugaaggggaaccugcccuuccagaacgugcacccggucaccaucggcgagugccccaaguacgugaaguccacccagcuccgcauggccaccgggcugcggaacauccccagcauccagucccgcggccuguucggggcgaucgccggcuucaucgagggcggguggacgggcaugguggacgggugguacggcuaccaccaccggaacgagcaggggagcggcuacgccgccgaccagaaguccacccagaucgccaucgacggcaucagcaacaaggucaacuccgugaucgagaagaugaacauccaguucaccagcguggggaaggaguucaacucccucgagaagcgcauggagaaccugaacaagaaggucgacgacggcuuccuggacguguggaccuacaacgcggagcuccugauccugcucgagaacgagcggacgcuggacuuccacgaccugaacgucaagaaccucuacgagaaggucaagagccagcugcgcaacaacgccaaggagaucgggaacggcugcuucgaguucuaccacaagugcgacaacgagugcauggaguccgugaagaacgggaccuacaacuaccccaaguacagcgaggaguccaagcugaaccgggaggagaucgacggcgugaagcucgagagcaugggcauccaccagauccuggccaucuacuccaccguggccagcagccuggugcuccuggucucccugggggccaucagcuucuggaugugcuccaacggcagccuccagugccgcgugugcaucuga

SEQ ID NO: 67394 - RNA, 1698 nt, Artificial Sequence; identical to SEQ ID NO: 64139
  derived and/or modified sequence opt1 from hemagglutinin__InfluenzaA__ADW09101

SEQ ID NO: 67395 - RNA, 1698 nt, Artificial Sequence
  derived and/or modified sequence opt1 from hemagglutinin__InfluenzaA__ADW09111
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccgcggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgaccagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggucaagcucgaguccaugggcguguaccagauccuggcgaucuacagcaccguggccagcucccugguccuccuggugagccugggcgccaucuccuucuggaugugcagcaacgggucccuccagugccggaucugcaucuga

SEQ ID NO: 67396 - RNA, 1698 nt, Artificial Sequence
  derived and/or modified sequence opt1 from hemagglutinin__InfluenzaA__ADW09120
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccacacggagaacgccuacgugagcguggucagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucuccaagggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 67397 - RNA, 1698 nt, Artificial Sequence; identical to SEQ ID NO: 64624
  derived and/or modified sequence opt1 from hemagglutinin__InfluenzaA__ADW09131

SEQ ID NO: 67398 - RNA, 1698 nt, Artificial Sequence
  derived and/or modified sequence opt1 from hemagglutinin__InfluenzaA__ADW09153
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcaggacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 67399 - RNA, 1698 nt, Artificial Sequence; identical to SEQ ID NO: 64624
  derived and/or modified sequence opt1 from hemagglutinin__InfluenzaA__ADW09164

SEQ ID NO: 67400 - RNA, 1698 nt, Artificial Sequence
  derived and/or modified sequence opt1 from hemagglutinin__InfluenzaA__ADW09186
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacacccccuccauccagagccgggggcuguucggcgccaucgccggguucaucgagggcggcuggacggggaugguggacggcugguacggguaccaccaccagaacgagcagggcuccggguacgccgcggaccagaaguccacccagaacgccaucaacggcaucaccaacaaggucaacagcgugaucgagaagaugaacacccaguucacggccgucggcaaggaguucaacaagcuggagcgccggauggagaaccucaacaagaagguggacgacggguucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacagcacgguggccagcucccugguccuccuggugagccugggcgccaucuccuucuggaugugcagcaacgggucccuccagugccgcaucugcaucuga

SEQ ID NO: 67401 - RNA, 1698 nt, Artificial Sequence; identical to SEQ ID NO: 64139
  derived and/or modified sequence opt1 from hemagglutinin__InfluenzaA__ADW09197

SEQ ID NO: 67402 - RNA, 1698 nt, Artificial Sequence; identical to SEQ ID NO: 64624
  derived and/or modified sequence opt1 from hemagglutinin__InfluenzaA__ADW09208

SEQ ID NO: 67403 - RNA, 1698 nt, Artificial Sequence; identical to SEQ ID NO: 64624
  derived and/or modified sequence opt1 from hemagglutinin__InfluenzaA__ADW09219

SEQ ID NO: 67404 - RNA, 1698 nt, Artificial Sequence; identical to SEQ ID NO: 64139
  derived and/or modified sequence opt1 from hemagglutinin__InfluenzaA__ADW09230

SEQ ID NO: 67405 - RNA, 1698 nt, Artificial Sequence
  derived and/or modified sequence opt1 from hemagglutinin__InfluenzaA__ADW09241
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagaugcgcgagcagcuguccagcguguccagcuucgagcgguucgagaucuucccgaaggaguccagcuggcccaaccacacggucaccgggguguccgccagcugcucccacaacggcgagagcuccuucuaccgcaaccuccuguggcugaccgugaagaacgggcucuaccccaaccugagcaaguccuacgccaacaacaaggagaaggagguccuggugcucuggggcgugcaccacccgcccaacaucgucgaccagaagacccuguaccggacggagaacgccuacgugagcguggucagcucccacuacagccgcaaguucacccccgagaucgccaagcggcccaaggugcgcgaccaggaggggcggaucaacuacuacuggacccugcucgagcccggcgacaccaucaucuucgaggccaacggcaaccugaucgcgccgcgcuacgccuucgcccugucccggggguucggcagcgggaucaucaacuccaacgcccccauggacaagugcgacgccaagugccagacgccccgcggcgcgaucaacagcucccuccccuuccagaacgugcacccggucaccaucggcgagugccccaaguacgugcggagcgccaagcugcgcauggugaccgggcugcggaacauccccuccauccagagccgcggccucuucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccugaacaagaagguggacgacggcuucaucgacaucuggacguacaacgccgagcuccugguccugcucgagaacgagcggacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcuggaguccauggggguguaccagauccucgcgaucuacagcaccgucgccagcucccuggugcugcucgugagccugggcgccaucuccuucuggaugugcagcaacggcucccugcagugccggaucugcaucuga

SEQ ID NO: 67406 - RNA, 1698 nt, Artificial Sequence; identical to SEQ ID NO: 64624
  derived and/or modified sequence opt1 from hemagglutinin__InfluenzaA__ADW09252

SEQ ID NO: 67407 - RNA, 1698 nt, Artificial Sequence
  derived and/or modified sequence opt1 from hemagglutinin__InfluenzaA__ADW09274
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaagcccuacgccaacaacaaggagaaggagguccucgugcuguggggcgugcaccacccgcccaacaucgucgaccagaagacccuguaccggacggagaacgccuacguguccguggucagcagccacuacucccgcaaguucacccccgagaucgccaagcggcccaaggugcgcgaccaggaggggcggaucaacuacuacuggacccuccuggagccgggcgacaccaucaucuucgaggccaacggcaaccugaucgcgccccgcuacgccuucgcccucagccggggguucggcuccgggaucaucaacagcaacgcccccauggacaagugcgacgccaagugccagacgccccgcggcgcgaucaacuccagccugccguuccagaacgugcaccccgucaccaucggcgagugccccaaguacgugcgguccgccaagcugcgcauggugaccgggcuccggaacauccccagcauccagucccgcggccuguucggggccaucgccggcuucaucgagggcggcuggaccggcauggucgacgggugguacggcuaccaccaccagaacgagcaggggagcggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuacccgaaguacagcgaggaguccaagcugaaccgcgagaagaucgacggcgugaagcucgagagcauggggguguaccagauccuggcgaucuacuccaccgucgccagcagccuggugcuccuggugucccugggcgccaucagcuucuggaugugcuccaacggcagccuccagugccggaucugcaucuga

SEQ ID NO: 67408 - RNA, 1698 nt, Artificial Sequence
  derived and/or modified sequence opt1 from hemagglutinin__InfluenzaA__ADW09285
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucacguucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggucaacagcgugaucgagaagaugaacacccaguucacggccgucggcaaggaguucaacaagcuggagcgccggauggagaaccucaacaagaagguggacgacggguucaucgacaucuggaccuacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacagcacgguggccagcucccugguccuccuggugagccugggcgccaucuccuucuggaugugcagcaacgggucccuccagugccgcaucugcaucuga

SEQ ID NO: 67409 - RNA, 1698 nt, Artificial Sequence; identical to SEQ ID NO: 64624
  derived and/or modified sequence opt1 from hemagglutinin__InfluenzaA__ADW09296

SEQ ID NO: 67410 - RNA, 1698 nt, Artificial Sequence; identical to SEQ ID NO: 64139
  derived and/or modified sequence opt1 from hemagglutinin__InfluenzaA__ADW09307

SEQ ID NO: 67411 - RNA, 1698 nt, Artificial Sequence
  derived and/or modified sequence opt1 from hemagglutinin__InfluenzaA__ADW09327
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 67412 - RNA, 1698 nt, Artificial Sequence; identical to SEQ ID NO: 64624
  derived and/or modified sequence opt1 from hemagglutinin__InfluenzaA__ADW10483

SEQ ID NO: 67413 - RNA, 1698 nt, Artificial Sequence
  derived and/or modified sequence opt1 from hemagglutinin__InfluenzaA__ADW10494
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagaaccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggggucaagcucgagagcaugggcguguaccagauccuggcgaucuacuccaccguggccagcagccugguccuccuggugucccugggcgccaucagcuucuggaugugcuccaacgggagccuccagugccgcaucugcaucuga

SEQ ID NO: 67414 - RNA, 1698 nt, Artificial Sequence; identical to SEQ ID NO: 64624
  derived and/or modified sequence opt1 from hemagglutinin__InfluenzaA__ADW10505

SEQ ID NO: 67415 - RNA, 1698 nt, Artificial Sequence; identical to SEQ ID NO: 64624
  derived and/or modified sequence opt1 from hemagglutinin__InfluenzaA__ADW10516

SEQ ID NO: 67416 - RNA, 1698 nt, Artificial Sequence
  derived and/or modified sequence opt1 from hemagglutinin__InfluenzaA__ADW10527
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggcugggcaucaucaacagcaacgcccccauggacaagugcgacgccaagugccagacgccccagggcgcgaucaacuccagccugcccuuccagaacgugcacccggugaccaucggggagugccccaaguacguccgcuccgccaagcuccggauggugaccggccugcgcaacauccccagcauccagucccgggggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggucaacagcgugaucgagaagaugaacacccaguucaccgccgucggcaaggaguucaacaagcucgagcgccggauggagaaccugaacaagaagguggacgacggguucaucgacaucuggacguacaacgccgagcugcucgugcugcuggagaacgagcgcacccucgacuuccacgacuccaacgucaagaaccuguacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcucaaccgggagaagaucgacggggugaagcuggagagcaugggcguguaccagauccuggcgaucuacuccaccguggccagcagccucguccugcuggugucccucggcgccaucagcuucuggaugugcuccaacgggagccugcagugccgcaucugcaucuga

SEQ ID NO: 67417 - RNA, 1698 nt, Artificial Sequence
  derived and/or modified sequence opt1 from hemagglutinin__InfluenzaA__ADW10538
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcgugaugagcucccacuacagccgcaaguucacccccgagaucgccaagcggcccaaggugcgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 67418 - RNA, 1698 nt, Artificial Sequence; identical to SEQ ID NO: 64624
  derived and/or modified sequence opt1 from hemagglutinin__InfluenzaA__ADW10549

SEQ ID NO: 67419 - RNA, 1698 nt, Artificial Sequence
  derived and/or modified sequence opt1 from hemagglutinin__InfluenzaA__ADW10560
augaaggugaagcugcucguccugcugugcaccuucaccgccacguacgccgacaccaucugcaucggcuaccacgcgaacaacagcaccgacaccguggacacgguguucgagaagaacgucaccgugacccacuccgugaaccuccuggagaacagccacaacgggaagcugugccuccugaagggcaucgcgccccugcagcucgggaacugcuccgucgccggcuggauccuggggaacccggagugcgagcugcucaucagcaaggaguccuggagcuacaucguggagaagcccaaccccgagaacgggaccugcuaccccggccacuucgccgacuacgaggagcugcgcgagcagcuguccagcguguccagcuucgagcgguucgagaucuucccgaaggaguccagcuggcccaaccacacggucaccgggguguccgccagcugcucccacaacggcgagcgcagcuucuaccggaaccuccuguggcugaccgggaagaacggccucuaccccaaccuguccaagagcuacgccaacaacaaggagaaggaggugcugguccucuggggcgugcaccacccgcccgacaucggcgaccagaagacccuguaccacacggagaacgccuacguguccgucgugagcagccacuacucccgcaaguucacccccgagaucgccaagcggcccaaggugcgcgaccaggagggccggaucaacuacuacuggacccugcucgagcccggggacaccaucaucuucgaggccaacggcaaccugaucgcgccgcgcuacgccuucgcccugagccggggguucggcuccggcaucaucaacagcaacgcccccauggacaagugcgacgccaagugccagacgccccagggggcgaucaacuccagccuccccuuccagaacguccacccggugaccaucggcgagugccccaaguacgugcgcuccgccaagcugcggauggucaccgggcugcgcaacauccccagcauccagucccggggccucuucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccugaacaagaaggucgacgacggcuucaucgacaucuggacguacaacgccgagcuccuggugcugcucgagaacgagcgcacccuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcuggagagcaugggcgucuaccagauccucgcgaucuacuccaccguggccagcagccuggugcugcucgucucccugggggccaucagcuucuggaugugcuccaacggcagccugcagugccgcaucugcaucuga

SEQ ID NO: 67420 - RNA, 1698 nt, Artificial Sequence; identical to SEQ ID NO: 66961
  derived and/or modified sequence opt1 from hemagglutinin__InfluenzaA__ADW10571

SEQ ID NO: 67421 - RNA, 1698 nt, Artificial Sequence; identical to SEQ ID NO: 64139
  derived and/or modified sequence opt1 from hemagglutinin__InfluenzaA__ADW10582

SEQ ID NO: 67422 - RNA, 1698 nt, Artificial Sequence; identical to SEQ ID NO: 64624
  derived and/or modified sequence opt1 from hemagglutinin__InfluenzaA__ADW10593

SEQ ID NO: 67423 - RNA, 1698 nt, Artificial Sequence; identical to SEQ ID NO: 64624
  derived and/or modified sequence opt1 from hemagglutinin__InfluenzaA__ADW10604

SEQ ID NO: 67424 - RNA, 1698 nt, Artificial Sequence; identical to SEQ ID NO: 64624
  derived and/or modified sequence opt1 from hemagglutinin__InfluenzaA__ADW10615

SEQ ID NO: 67425 - RNA, 1698 nt, Artificial Sequence
  derived and/or modified sequence opt1 from hemagglutinin__InfluenzaA__ADW10626
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccagcaucgucgaccagaagacccuguaccggacggagaacgccuacgugagcguggucuccagccacuacucccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucagccggggguucggcuccgggaucaucaacagcaacgcccccauggacaagugcgacgccaagugccagacgccccgcggcgcgaucaacuccagccugcccuuccagaacgugcacccggucaccaucggcgagugccccaaguacgugcgguccgccaagcugcgcauggugaccgggcuccggaacauccccagcauccagucccgcggccuguucggggccaucgccggcuucaucgagggcggcuggaccggcauggucgacgggugguacggcuaccaccaccagaacgagcaggggagcggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcauggggguguaccagauccuggcgaucuacagcaccgucgccuccagccuggugcuccuggugucccugggcgccaucagcuucuggaugugcuccaacggcagccuccagugccggaucugcaucuga

SEQ ID NO: 67426 - RNA, 1698 nt, Artificial Sequence
  derived and/or modified sequence opt1 from hemagglutinin__InfluenzaA__ADW10721
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucaagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagcggacccuguaccacacggagaacgccuacgugagcguggucagcucccacuacagccgcaaguucacccccgagaucgccaagcggcccaaggugcgcaaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 67427 - RNA, 1698 nt, Artificial Sequence
  derived and/or modified sequence opt1 from hemagglutinin__InfluenzaA__ADW10743
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacaccuacgugagcguggucagcucccacuacagccgcaaguucacccccgagaucgccaagcggcccaagauccgcgaccaggaggggcggaucaacuacuacuggacccuccuggagcccggcgacacgaucaucuucgaggccaacggcaaccugaucgccccgcgcuacgcguucgcccucucccggggguucggcagcgggaucaucaacuccaacgcccccauggacaagugcgacgccaagugccagacgccccgcggcgccaucaacagcucccugcccuuccagaacgugcacccggugaccaucggcgagugccccaaguacguccggagcgugaagcugcgcauggugaccgggcuccggaacauccccuccauccagagccgcggccuguucggggcgaucgccggcuucaucgagggcggcuggaccggcauggucgacgggugguacggcuaccaccaccagaacgagcagggguccggcuacgccgccgaccagaaguccacccagaacgccaucaacgggaucaccaacaaggugaacagcgucaucgagaagaugaacacccaguucacggcggugggcaaggaguucaacaagcuggagcggcgcauggagaaccucaacaagaagguggacgacggcuucaucgacaucuggaccuacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggccaucuacagcacggucgccagcucccuggugcuccuggugagccugggcgcgaucuccuucuggaugugcagcaacggcucccuccagugccggaucugcaucuga

SEQ ID NO: 67428 - RNA, 1698 nt, Artificial Sequence
  derived and/or modified sequence opt1 from hemagglutinin__InfluenzaA__ADW10754
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcgugcagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacuccaacgucaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccguggccagcagccugguccuccuggugucccugggcgccaucagcuucuggaugugcuccaacgggagccuccagugccggaucugcaucuga

SEQ ID NO: 67429 - RNA, 1698 nt, Artificial Sequence
  derived and/or modified sequence opt1 from hemagglutinin__InfluenzaA__ADW10765
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccacacggagaacgccuacgugagcguggucagcucccacuacagccggaaguucacccccgagaucgccaagcgccccaaggugcggaaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccggggcgcgaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccgcaucugcaucuga

SEQ ID NO: 67430 - RNA, 1698 nt, Artificial Sequence
  derived and/or modified sequence opt1 from hemagglutinin__InfluenzaA__ADW10776
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacgacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 67431 - RNA, 1698 nt, Artificial Sequence
  derived and/or modified sequence opt1 from hemagglutinin__InfluenzaA__ADW10787
augaaggugaagauccugguccuccugugcaccuucaccgccacguacgccgacaccaucugcaucggcuaccacgcgaacaacagcaccgacaccguggacacggugcuggagaagaacgucaccgugacccacuccgugaaccuccuggagaacagccacaacgggaagcugugccuccugaagggcaucgcgccccugcagcucgggaacugcuccgucgccggcuggauccuggggaacccggagugcgagcugcucaucagcaaggaguccuggagcuacaucguggagaagcccaaccccgagaacgggaccugcuaccccggccacuucgccgacuacgaggagcugcgcgagcagcuguccagcguguccagcuucgagcgguucgagaucuucccgaaggaguccagcuggcccaaccacacggucaccgggguguccgccagcugcucccacaacggcgagagcuccuucuaccgcaaccuccuguggcugaccgugaagaacgggcucuaccccaaccugagcaaguccuacgccaacaacaaggagaaggagguccuggugcucuggggcgugcaccacccgcccaacaucgucgaccagaagacccuguaccggacggagaacgccuacgugagcguggucagcucccacuacagccgcaaguucacccccgagaucgccaagcggcccaaggugcgcgaccaggaggggcggaucaacuacuacuggacccugcucgagcccggcgacaccaucaucuucgaggccaacggcaaccugaucgcgccgcgcuacgccuucgcccugucccggggguucggcagcgggaucaucaacuccaacgcccccauggacaagugcgacgccaagugccagacgccccgcggcgcgaucaacagcucccuccccuuccagaacgugcacccggucaccaucggcgagugccccaaguacgugcggagcgccaagcugcgcauggugaccgggcugcggaacauccccuccauccagagccgcggccucuucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccugaacaagaagguggacgacggcuucaucgacaucuggacguacaacgccgagcuccugguccugcucgagaacgagcggacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcuggaguccauggggguguaccagauccucgcgaucuacagcaccgucgccagcucccuggugcugcucgugagccugggcgccaucuccuucuggaugugcagcaacggcucccugcagugccggaucugcaucuga

SEQ ID NO: 67432 - RNA, 1698 nt, Artificial Sequence
  derived and/or modified sequence opt1 from hemagglutinin__InfluenzaA__ADW10798
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggguggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggcgaucuacagcaccgucgccagcucccuggugcuccuggugagccugggggccaucuccuucuggaugugcagcaacggcucccuccagugccgcaucugcaucuga

SEQ ID NO: 67433 - RNA, 1698 nt, Artificial Sequence; identical to SEQ ID NO: 67429
  derived and/or modified sequence opt1 from hemagglutinin__InfluenzaA__ADW10809

SEQ ID NO: 67434 - RNA, 1698 nt, Artificial Sequence; identical to SEQ ID NO: 64624
  derived and/or modified sequence opt1 from hemagglutinin__InfluenzaA__ADW10820

SEQ ID NO: 67435 - RNA, 1698 nt, Artificial Sequence; identical to SEQ ID NO: 64139
  derived and/or modified sequence opt1 from hemagglutinin__InfluenzaA__ADW10831

SEQ ID NO: 67436 - RNA, 1698 nt, Artificial Sequence
  derived and/or modified sequence opt1 from hemagglutinin__InfluenzaA__ADW10842
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucgcccccgagaucgccaagcggcccaaggugcgcgaccaggaggggcggaucaacuacuacuggacccuccuggagcccggcgacaccaucaucuucgaggcgaacggcaaccugaucgccccgcgcuacgccuucgcccucucccggggguucggcagcgggaucaucaacuccaacgcccccauggacaagugcgacgcgaagugccagacgccccgcggcgccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggccaucuacagcaccgucgccagcucccuggugcuccuggugagccugggcgccaucuccuucuggaugugcagcaacggcucccuccagugccggaucugcaucuga

SEQ ID NO: 67437 - RNA, 1698 nt, Artificial Sequence; identical to SEQ ID NO: 66980
  derived and/or modified sequence opt1 from hemagglutinin__InfluenzaA__ADW10853

SEQ ID NO: 67438 - RNA, 1698 nt, Artificial Sequence; identical to SEQ ID NO: 67429
  derived and/or modified sequence opt1 from hemagglutinin__InfluenzaA__ADW10864

SEQ ID NO: 67439 - RNA, 1698 nt, Artificial Sequence; identical to SEQ ID NO: 67429
  derived and/or modified sequence opt1 from hemagglutinin__InfluenzaA__ADW10875

SEQ ID NO: 67440 - RNA, 1698 nt, Artificial Sequence; identical to SEQ ID NO: 64624
  derived and/or modified sequence opt1 from hemagglutinin__InfluenzaA__ADW10886

SEQ ID NO: 67441 - RNA, 1698 nt, Artificial Sequence
  derived and/or modified sequence opt1 from hemagglutinin__InfluenzaA__ADW10897
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacacgaagugccagacgccccagggcgccaucaacagcucccugcccuuccagaacguccacccggugaccaucggggagugccccaaguacgugcggagcgcgaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgccgaccagaaguccacccagaacgcgaucaacggcaucaccaacaaggugaacagcgucaucgagaagaugaacacccaguucacggccgugggcaaggaguucaacaagcuggagcggcgcauggagaaccucaacaagaaggucgacgacggguucaucgacaucuggaccuacaacgccgagcugcuggugcuccuggagaacgagcggacccuggacuuccacgacagcaacgugaagaaccucuacgagaaggucaagucccagcugaagaacaacgccaaggaggugggcaacgggugcuucgaguucuaccacaagugcaacgacgagugcauggagagcgugaagaacggcaccuacgacuaccccaaguacuccgaggagagcaagcugaaccgcgagaagaucgacggggucaagcucgagagcaugggcguguaccagauccuggccaucuacuccacgguggcgagcucccugguccuccuggugagccugggcgccaucuccuucuggaugugcagcaacgggucccuccagugccggaucugcaucuga

SEQ ID NO: 67442 - RNA, 1701 nt, Artificial Sequence
  derived and/or modified sequence opt1 from hemagglutinin__InfluenzaA__ADW23115
augaagaccaucaucgcccugagcuacauccucugccugguguucgcccagaagcugcccggcaacgggaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacaacagcuucuucucccgccugaacuggcucacgcacagcaaguucaaguaccccgcccugaacgugaccaugcccaacaacgagcaguucgacaagcuguacaucuggggcguccaccaccccgggaccgacaacgaccagaucuuccucuacgcgcaggccuccggccggaucaccgugagcacgaagcgcagccagcagaccgugaucccgaacaucggcucccggccccgcguccggaacauccccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 67443 - RNA, 1701 nt, Artificial Sequence
  derived and/or modified sequence opt1 from hemagglutinin__InfluenzaA__ADW54481
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 67444 - RNA, 1701 nt, Artificial Sequence
  derived and/or modified sequence opt1 from hemagglutinin__InfluenzaA__ADW54512
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucaagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 67445 - RNA, 1701 nt, Artificial Sequence
  derived and/or modified sequence opt1 from hemagglutinin__InfluenzaA__ADW54527
augaaggccauccuggugguccuccuguacaccuucgccaccgcgagcgccgacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccaccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccacccgcccacguccgcggaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacaccccggugcacgacugcaacacgaccugccagacccccaacggcgccaucaacaccucccugcccuuccagaacauccaccccaucaccaucgggaagugcccgaaguacgucaagagcaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 67446 - RNA, 1701 nt, Artificial Sequence; identical to SEQ ID NO: 67443
  derived and/or modified sequence opt1 from hemagglutinin__InfluenzaA__ADW65825

SEQ ID NO: 67447 - RNA, 1701 nt, Artificial Sequence
  derived and/or modified sequence opt1 from hemagglutinin__InfluenzaA__ADW82135
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguacaccgcccugaacgucaccaugcccaacaacgagcaguucgacaagcucuacaucuggggcgugcaccaccccgggaccgacaaggaccagaucuuccuguacgcgcaggccagcgggcggaucacgguguccaccaagcgcagccagcagaccgucauccccaacaucggcagccggccgcgcgugcggaacauccccucccgcaucagcaucuacuggaccaucgugaagcccggcgacauccugcucaucaacuccacggggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 67448 - RNA, 1701 nt, Artificial Sequence; identical to SEQ ID NO: 67447
  derived and/or modified sequence opt1 from hemagglutinin__InfluenzaA__ADW82155

SEQ ID NO: 67449 - RNA, 1701 nt, Artificial Sequence; identical to SEQ ID NO: 67447
  derived and/or modified sequence opt1 from hemagglutinin__InfluenzaA__ADW82166

SEQ ID NO: 67450 - RNA, 1701 nt, Artificial Sequence; identical to SEQ ID NO: 67447
  derived and/or modified sequence opt1 from hemagglutinin__InfluenzaA__ADW82177

SEQ ID NO: 67451 - RNA, 1701 nt, Artificial Sequence; identical to SEQ ID NO: 63677
  derived and/or modified sequence opt1 from hemagglutinin__InfluenzaA__ADW82188

SEQ ID NO: 67452 - RNA, 1701 nt, Artificial Sequence; identical to SEQ ID NO: 63677
  derived and/or modified sequence opt1 from hemagglutinin__InfluenzaA__ADW82198

SEQ ID NO: 67453 - RNA, 1701 nt, Artificial Sequence; identical to SEQ ID NO: 63677
  derived and/or modified sequence opt1 from hemagglutinin__InfluenzaA__ADW82208

SEQ ID NO: 67454 - RNA, 1701 nt, Artificial Sequence; identical to SEQ ID NO: 63677
  derived and/or modified sequence opt1 from hemagglutinin__InfluenzaA__ADW82218

SEQ ID NO: 67455 - RNA, 1701 nt, Artificial Sequence; identical to SEQ ID NO: 63677
  derived and/or modified sequence opt1 from hemagglutinin__InfluenzaA__ADW82228

SEQ ID NO: 67456 - RNA, 1701 nt, Artificial Sequence; identical to SEQ ID NO: 63677
  derived and/or modified sequence opt1 from hemagglutinin__InfluenzaA__ADW82238

SEQ ID NO: 67457 - RNA, 1701 nt, Artificial Sequence; identical to SEQ ID NO: 63677
  derived and/or modified sequence opt1 from hemagglutinin__InfluenzaA__ADW82248

SEQ ID NO: 67458 - RNA, 1701 nt, Artificial Sequence; identical to SEQ ID NO: 63677
  derived and/or modified sequence opt1 from hemagglutinin__InfluenzaA__ADW82258

SEQ ID NO: 67459 - RNA, 1701 nt, Artificial Sequence
  derived and/or modified sequence opt1 from hemagglutinin__InfluenzaA__ADW82268
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcauccaccagauccuggcgaucuacuccaccgucgccagcagccuggugcucguggucucccugggggccaucagcuucuggaugugcuccaacggcagccugcagugccggaucugcaucuga

SEQ ID NO: 67460 - RNA, 1701 nt, Artificial Sequence; identical to SEQ ID NO: 67447
  derived and/or modified sequence opt1 from hemagglutinin__InfluenzaA__ADW93760

SEQ ID NO: 67461 - RNA, 1701 nt, Artificial Sequence
  derived and/or modified sequence opt1 from hemagglutinin__InfluenzaA__ADW95319
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 67462 - RNA, 1701 nt, Artificial Sequence
  derived and/or modified sequence opt1 from hemagglutinin__InfluenzaA__ADW95332
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 67463 - RNA, 1701 nt, Artificial Sequence
  derived and/or modified sequence opt1 from hemagglutinin__InfluenzaA__ADX21078
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguacaccgcccugaacgucaccaugcccaacaacgagcaguucgacaagcucuacaucuggggcgugcaccaccccgggaccgacaaggaccagaucuuccuguacgcgcaggccagcgggcggaucacgguguccaccaagcgcagccagcagaccgucauccccaacaucggcagccggccgcgcgugcggaacauccccucccgcaucagcaucuacuggaccaucgugaagcccggcgacauccugcucaucaacuccacggggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucauccggaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcguggagcugaaguccggguacaaggacuggauccuguggaucuccuucgccaucagcugcuuccuccugugcgucgcccugcucggcuucaucaugugggccugccagaagggcaacauccgcugcaacaucugcaucuga

SEQ ID NO: 67464 - RNA, 1701 nt, Artificial Sequence; identical to SEQ ID NO: 67463
  derived and/or modified sequence opt1 from hemagglutinin__InfluenzaA__ADX21088

SEQ ID NO: 67465 - RNA, 1701 nt, Artificial Sequence
  derived and/or modified sequence opt1 from hemagglutinin__InfluenzaA__ADX21098
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcuccacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcauccaccagauccuggcgaucuacagcaccgucgccagcucccuggugcucguggucagccugggggccaucuccuucuggaugugcagcaacggcucccugcagugccggaucugcaucuga

SEQ ID NO: 67466 - RNA, 1701 nt, Artificial Sequence; identical to SEQ ID NO: 64596
  derived and/or modified sequence opt1 from hemagglutinin__InfluenzaA__ADX36109

SEQ ID NO: 67467 - RNA, 1701 nt, Artificial Sequence
  derived and/or modified sequence opt1 from hemagglutinin__InfluenzaA__ADX96278
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccagcgccgaccagcagucccucuaccagaacgccgacgccuacguguucgugggcagcucccgguacagcaagaaguucaagcccgagaucgccauccgcccgaagguccgggaccaggaggggcgcaugaacuacuacuggacgcugguggagcccggcgacaagaucaccuucgaggcgaccgggaaccugguggucccccgguacgccuucgccauggagcgcaacgccggcuccggcaucaucaucagcgacacccccgugcacgacugcaacacgaccugccagaccccgaagggggccgugaacaccucccuccccuuccagaacauccaccccaucacgaucggcaagugccccaaguacgucaagagcaccaagcugcggcuggcgaccgggcuccgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacgcagaacgcgaucgacgagaucaccaacaaggucaacuccgugaucgagaagaugaacacccaguucaccgccgucggcaaggaguucaaccaccuggagaagcgcaucgagaaccugaacaagaagguggacgacggguuccuggacaucuggacguacaacgccgagcuccuggugcugcucgagaacgagcggacccuggacuaccacgacagcaacgucaagaaccuguacgagaaggugcgcucccagcucaagaacaacgccaaggaggugggcaacgggugcuucgaguucuaccacaagugcgacaacacgugcauggagagcgucaagaacggcaccuacgacuaccccaaguacuccgaggaggccaagcugaaccgggaggagaucgacggggugaagcuggagagcacccgcaucuaccagauccucgcgaucuacuccaccgccgccagcagccuggugcuggucgugucccucggcgccaucagcuucuggaugugcuccaacggcagccugcagugccggaucugcaucuga

SEQ ID NO: 67468 - RNA, 1701 nt, Artificial Sequence
  derived and/or modified sequence opt1 from hemagglutinin__InfluenzaA__ADX96288
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagcaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccgccgccagcucccuggugcugguggucagccucggggccaucuccuucuggaugugcagcaacggcucccugcagugccggaucugcaucuga

SEQ ID NO: 67469 - RNA, 1701 nt, Artificial Sequence
  derived and/or modified sequence opt1 from hemagglutinin__InfluenzaA__ADX96298
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgucauccgcccgaaggugcgggaccaggagggccgcaugaacuacuacuggacccugguggagcccggggacaagaucaccuucgaggccaccggcaaccuggucgugccccgguacgcguucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgccaucuacuccaccguggcgagcagccuggugcuggucgugucccucggggccaucagcuucuggaugugcuccaccggcagccugcagugccggaucugcaucuga

SEQ ID NO: 67470 - RNA, 1701 nt, Artificial Sequence; identical to SEQ ID NO: 65274
  derived and/or modified sequence opt1 from hemagglutinin__InfluenzaA__ADX96308

SEQ ID NO: 67471 - RNA, 1701 nt, Artificial Sequence
  derived and/or modified sequence opt1 from hemagglutinin__InfluenzaA__ADX96318
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 67472 - RNA, 1701 nt, Artificial Sequence
  derived and/or modified sequence opt1 from hemagglutinin__InfluenzaA__ADX96328
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 67473 - RNA, 1701 nt, Artificial Sequence
  derived and/or modified sequence opt1 from hemagglutinin__InfluenzaA__ADX96347
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67474 - RNA, 1701 nt, Artificial Sequence
  derived and/or modified sequence opt1 from hemagglutinin__InfluenzaA__ADX96357
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgucauccgcccgaaggugcgggaccaggagggccgcaugaacuacuacuggacccugguggagcccggggacaagaucaccuucgaggccaccggcaaccuggucgugccccgguacgcguucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggccaccggccuccgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgccaucuacuccaccguggcgagcagccuggugcuggucgugucccucggggccaucagcuucuggaugugcuccaacggcagccugcagugccggaucugcaucuga

SEQ ID NO: 67475 - RNA, 1701 nt, Artificial Sequence; identical to SEQ ID NO: 66614
  derived and/or modified sequence opt1 from hemagglutinin__InfluenzaA__ADX96367

SEQ ID NO: 67476 - RNA, 1701 nt, Artificial Sequence
  derived and/or modified sequence opt1 from hemagglutinin__InfluenzaA__ADX96378
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccauccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67477 - RNA, 1701 nt, Artificial Sequence; identical to SEQ ID NO: 67476
  derived and/or modified sequence opt1 from hemagglutinin__InfluenzaA__ADX96398

SEQ ID NO: 67478 - RNA, 1701 nt, Artificial Sequence
  derived and/or modified sequence opt1 from hemagglutinin__InfluenzaA__ADX96408
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccauccacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgcgaucuacuccaccguggccagcagccugguccugguggugucccucggggccaucagcuucuggaugugcuccaacggcagccugcagugccggaucugcaucuga

SEQ ID NO: 67479 - RNA, 1701 nt, Artificial Sequence; identical to SEQ ID NO: 63990
  derived and/or modified sequence opt1 from hemagglutinin__InfluenzaA__ADX96427

SEQ ID NO: 67480 - RNA, 1701 nt, Artificial Sequence
  derived and/or modified sequence opt1 from hemagglutinin__InfluenzaA__ADX96437
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgccuggagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccgccgccagcucccuggugcucguggucagccugggggccaucuccuucuggaugugcagcaacggcucccugcagugccggaucugcaucuga

SEQ ID NO: 67481 - RNA, 1701 nt, Artificial Sequence; identical to SEQ ID NO: 63664
  derived and/or modified sequence opt1 from hemagglutinin__InfluenzaA__ADX96447

SEQ ID NO: 67482 - RNA, 1701 nt, Artificial Sequence; identical to SEQ ID NO: 63677
  derived and/or modified sequence opt1 from hemagglutinin__InfluenzaA__ADX96497

SEQ ID NO: 67483 - RNA, 1701 nt, Artificial Sequence
  derived and/or modified sequence opt1 from hemagglutinin__InfluenzaA__ADX96507
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaccggcagccugcagugccggaucugcaucuga

SEQ ID NO: 67484 - RNA, 1701 nt, Artificial Sequence; identical to SEQ ID NO: 67483
  derived and/or modified sequence opt1 from hemagglutinin__InfluenzaA__ADX96517

SEQ ID NO: 67485 - RNA, 1701 nt, Artificial Sequence
  derived and/or modified sequence opt1 from hemagglutinin__InfluenzaA__ADX96527
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuuccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67486 - RNA, 1701 nt, Artificial Sequence; identical to SEQ ID NO: 63677
  derived and/or modified sequence opt1 from hemagglutinin__InfluenzaA__ADX96537

SEQ ID NO: 67487 - RNA, 1701 nt, Artificial Sequence; identical to SEQ ID NO: 63677
  derived and/or modified sequence opt1 from hemagglutinin__InfluenzaA__ADX96547

SEQ ID NO: 67488 - RNA, 1701 nt, Artificial Sequence; identical to SEQ ID NO: 64778
  derived and/or modified sequence opt1 from hemagglutinin__InfluenzaA__ADX96557

SEQ ID NO: 67489 - RNA, 1701 nt, Artificial Sequence; identical to SEQ ID NO: 63677
  derived and/or modified sequence opt1 from hemagglutinin__InfluenzaA__ADX96587

SEQ ID NO: 67490 - RNA, 1701 nt, Artificial Sequence; identical to SEQ ID NO: 63664
  derived and/or modified sequence opt1 from hemagglutinin__InfluenzaA__ADX96597

SEQ ID NO: 67491 - RNA, 1701 nt, Artificial Sequence; identical to SEQ ID NO: 63664
  derived and/or modified sequence opt1 from hemagglutinin__InfluenzaA__ADX96607

SEQ ID NO: 67492 - RNA, 1701 nt, Artificial Sequence
  derived and/or modified sequence opt1 from hemagglutinin__InfluenzaA__ADX96627
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaccggcagccugcagugccgcaucugcaucuga

SEQ ID NO: 67493 - RNA, 1701 nt, Artificial Sequence; identical to SEQ ID NO: 64124
  derived and/or modified sequence opt1 from hemagglutinin__InfluenzaA__ADX96637

SEQ ID NO: 67494 - RNA, 1701 nt, Artificial Sequence; identical to SEQ ID NO: 63677
  derived and/or modified sequence opt1 from hemagglutinin__InfluenzaA__ADX96647

SEQ ID NO: 67495 - RNA, 1701 nt, Artificial Sequence; identical to SEQ ID NO: 63664
  derived and/or modified sequence opt1 from hemagglutinin__InfluenzaA__ADX96657

SEQ ID NO: 67496 - RNA, 1701 nt, Artificial Sequence; identical to SEQ ID NO: 63677
  derived and/or modified sequence opt1 from hemagglutinin__InfluenzaA__ADX96667

SEQ ID NO: 67497 - RNA, 1701 nt, Artificial Sequence
  derived and/or modified sequence opt1 from hemagglutinin__InfluenzaA__ADX96677
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacggugguggagcccggggacaagaucaccuucgaggcgaccggcaaccuggucgugccccgguacgccuucgccauggagcgcaacgccgggagcggcaucaucaucuccgacacccccgugcacgacugcaacacgaccugccagaccccgaagggcgccaucaacaccagccuccccuuccacaacauccaccccaucacgaucgggaagugccccaaguacgucaaguccaccaagcugcggcuggcgaccggccuccgcaacgugccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggucaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccguggccagcucccuggugcuggucgugagccucggggccaucuccuucuggaugugcagcaacggcucccugcagugccggaucugcaucuga

SEQ ID NO: 67498 - RNA, 1701 nt, Artificial Sequence
  derived and/or modified sequence opt1 from hemagglutinin__InfluenzaA__ADX96687
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucaagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccguguacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67499 - RNA, 1701 nt, Artificial Sequence; identical to SEQ ID NO: 63677
  derived and/or modified sequence opt1 from hemagglutinin__InfluenzaA__ADX96697

SEQ ID NO: 67500 - RNA, 1701 nt, Artificial Sequence
  derived and/or modified sequence opt1 from hemagglutinin__InfluenzaA__ADX96707
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcgacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaccggcagccugcagugccggaucugcaucuga

SEQ ID NO: 67501 - RNA, 1701 nt, Artificial Sequence; identical to SEQ ID NO: 64837
  derived and/or modified sequence opt1 from hemagglutinin__InfluenzaA__ADX96727

SEQ ID NO: 67502 - RNA, 1701 nt, Artificial Sequence
  derived and/or modified sequence opt1 from hemagglutinin__InfluenzaA__ADX96737
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaaggucaaggagcaggagggccggaugaacuacuacuggacccugguggagcccggggacaagaucaccuucgaggcgaccggcaaccucguggucccccgcuacgccuucgccauggagcggaaggccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgcgaggagaucgacggcgugaagcucgaguccacccggaucuaccagauccuggcgaucuacagcaccgucgccagcucccuggugcucgugaucagccugggggccaucuccuucuggaugugcagcaccggcucccugcagugccgcaucugcaucuga

SEQ ID NO: 67503 - RNA, 1701 nt, Artificial Sequence; identical to SEQ ID NO: 63677
  derived and/or modified sequence opt1 from hemagglutinin__InfluenzaA__ADX96747

SEQ ID NO: 67504 - RNA, 1701 nt, Artificial Sequence
  derived and/or modified sequence opt1 from hemagglutinin__InfluenzaA__ADX96757
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggugcccggcgacaagaucaccuucgaggcgaccgggaaccucgucgugccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaccggcagccugcagugccggaucugcaucuga

SEQ ID NO: 67505 - RNA, 1701 nt, Artificial Sequence
  derived and/or modified sequence opt1 from hemagglutinin__InfluenzaA__ADX96767
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggaguccggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaagcucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaccggcucccugcagugccggaucugcaucuga

SEQ ID NO: 67506 - RNA, 1701 nt, Artificial Sequence
  derived and/or modified sequence opt1 from hemagglutinin__InfluenzaA__ADX96777
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggugcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgucaaguccaccaagcugcggcucgcgaccggccugcgcaacgugcccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 67507 - RNA, 1701 nt, Artificial Sequence; identical to SEQ ID NO: 63677
  derived and/or modified sequence opt1 from hemagglutinin__InfluenzaA__ADX96787

SEQ ID NO: 67508 - RNA, 1701 nt, Artificial Sequence; identical to SEQ ID NO: 66904
  derived and/or modified sequence opt1 from hemagglutinin__InfluenzaA__ADX96797

SEQ ID NO: 67509 - RNA, 1701 nt, Artificial Sequence
  derived and/or modified sequence opt1 from hemagglutinin__InfluenzaA__ADX96807
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguucuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccguggccagcucccuggugcuggucgugagccucggggccaucuccuucuggaugugcagcaacggcucccugcagugccggaucugcaucuga

SEQ ID NO: 67510 - RNA, 1701 nt, Artificial Sequence; identical to SEQ ID NO: 63664
  derived and/or modified sequence opt1 from hemagglutinin__InfluenzaA__ADX96817

SEQ ID NO: 67511 - RNA, 1701 nt, Artificial Sequence
  derived and/or modified sequence opt1 from hemagglutinin__InfluenzaA__ADX96837
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccguacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccguggccagcucccuggugcuggucgugagccucggggccaucuccuucuggaugugcagcaccggcucccugcagugccggaucugcaucuga

SEQ ID NO: 67512 - RNA, 1701 nt, Artificial Sequence; identical to SEQ ID NO: 63677
  derived and/or modified sequence opt1 from hemagglutinin__InfluenzaA__ADX96847

SEQ ID NO: 67513 - RNA, 1701 nt, Artificial Sequence; identical to SEQ ID NO: 63677
  derived and/or modified sequence opt1 from hemagglutinin__InfluenzaA__ADX96857

SEQ ID NO: 67514 - RNA, 1701 nt, Artificial Sequence; identical to SEQ ID NO: 63857
  derived and/or modified sequence opt1 from hemagglutinin__InfluenzaA__ADX96867

SEQ ID NO: 67515 - RNA, 1701 nt, Artificial Sequence; identical to SEQ ID NO: 66614
  derived and/or modified sequence opt1 from hemagglutinin__InfluenzaA__ADX96877

SEQ ID NO: 67516 - RNA, 1701 nt, Artificial Sequence
  derived and/or modified sequence opt1 from hemagglutinin__InfluenzaA__ADX96897
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccauccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67517 - RNA, 1701 nt, Artificial Sequence
  derived and/or modified sequence opt1 from hemagglutinin__InfluenzaA__ADX96907
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacagcgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccagcaagggggucaccgccgccugcccgcacgccggcgcgaaguccuucuacaagaaccugaucuggcucgugaagaaggggaacagcuaccccaagcugagcaaguccuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 67518 - RNA, 1701 nt, Artificial Sequence
  derived and/or modified sequence opt1 from hemagglutinin__InfluenzaA__ADX96927
augaaggccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggaccgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 67519 - RNA, 1701 nt, Artificial Sequence; identical to SEQ ID NO: 65097
  derived and/or modified sequence opt1 from hemagglutinin__InfluenzaA__ADX96937

SEQ ID NO: 67520 - RNA, 1701 nt, Artificial Sequence; identical to SEQ ID NO: 63664
  derived and/or modified sequence opt1 from hemagglutinin__InfluenzaA__ADX96947

SEQ ID NO: 67521 - RNA, 1701 nt, Artificial Sequence; identical to SEQ ID NO: 64841
  derived and/or modified sequence opt1 from hemagglutinin__InfluenzaA__ADX96957

SEQ ID NO: 67522 - RNA, 1701 nt, Artificial Sequence; identical to SEQ ID NO: 63990
  derived and/or modified sequence opt1 from hemagglutinin__InfluenzaA__ADX96967

SEQ ID NO: 67523 - RNA, 1701 nt, Artificial Sequence; identical to SEQ ID NO: 63857
  derived and/or modified sequence opt1 from hemagglutinin__InfluenzaA__ADX96977

SEQ ID NO: 67524 - RNA, 1701 nt, Artificial Sequence
  derived and/or modified sequence opt1 from hemagglutinin__InfluenzaA__ADX96987
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcaucaagcuggaguccacccgcaucuaccagauccucgcgaucuacagcaccguggccagcucccugguccugguggugagccucggggccaucuccuucuggaugugcagcaacggcucccugcagugccggaucugcaucuga

SEQ ID NO: 67525 - RNA, 1701 nt, Artificial Sequence; identical to SEQ ID NO: 63857
  derived and/or modified sequence opt1 from hemagglutinin__InfluenzaA__ADX96997

SEQ ID NO: 67526 - RNA, 1701 nt, Artificial Sequence
  derived and/or modified sequence opt1 from hemagglutinin__InfluenzaA__ADX97007
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacgcccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 67527 - RNA, 1701 nt, Artificial Sequence; identical to SEQ ID NO: 67476
  derived and/or modified sequence opt1 from hemagglutinin__InfluenzaA__ADX97018

SEQ ID NO: 67528 - RNA, 1701 nt, Artificial Sequence
  derived and/or modified sequence opt1 from hemagglutinin__InfluenzaA__ADX97028
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagcaggggaacagcuaccccaagcucuccaagagcuacaucaacgacaagggcaaggaggugcugguccugugggggauccaccaccccagcaccacggccgaccagcagucccucuaccagaacgccgacgccuacguguucgugggcagcucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagguggggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccgccgccagcagccuggugcugguggucucccucggggccaucagcuucuggaugugcuccaacggcagccugcagugccggaucugcaucuga

SEQ ID NO: 67529 - RNA, 1701 nt, Artificial Sequence; identical to SEQ ID NO: 66230
  derived and/or modified sequence opt1 from hemagglutinin__InfluenzaA__ADX98640

SEQ ID NO: 67530 - RNA, 1701 nt, Artificial Sequence; identical to SEQ ID NO: 65229
  derived and/or modified sequence opt1 from hemagglutinin__InfluenzaA__ADX98650

SEQ ID NO: 67531 - RNA, 1701 nt, Artificial Sequence
  derived and/or modified sequence opt1 from hemagglutinin__InfluenzaA__ADX98665
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgccgccagcagccugguccucguggugucccugggcgccaucagcuucuggaugugcuccaacggcagccugcagugccggaucugcaucuga

SEQ ID NO: 67532 - RNA, 1701 nt, Artificial Sequence; identical to SEQ ID NO: 64841
  derived and/or modified sequence opt1 from hemagglutinin__InfluenzaA__ADX98675

SEQ ID NO: 67533 - RNA, 1701 nt, Artificial Sequence; identical to SEQ ID NO: 64841
  derived and/or modified sequence opt1 from hemagglutinin__InfluenzaA__ADX98695

SEQ ID NO: 67534 - RNA, 1701 nt, Artificial Sequence; identical to SEQ ID NO: 65229
  derived and/or modified sequence opt1 from hemagglutinin__InfluenzaA__ADX98729

SEQ ID NO: 67535 - RNA, 1701 nt, Artificial Sequence; identical to SEQ ID NO: 66560
  derived and/or modified sequence opt1 from hemagglutinin__InfluenzaA__ADX98739

SEQ ID NO: 67536 - RNA, 1701 nt, Artificial Sequence; identical to SEQ ID NO: 66309
  derived and/or modified sequence opt1 from hemagglutinin__InfluenzaA__ADX98748

SEQ ID NO: 67537 - RNA, 1701 nt, Artificial Sequence; identical to SEQ ID NO: 63677
  derived and/or modified sequence opt1 from hemagglutinin__InfluenzaA__ADX98758

SEQ ID NO: 67538 - RNA, 1701 nt, Artificial Sequence; identical to SEQ ID NO: 64030
  derived and/or modified sequence opt1 from hemagglutinin__InfluenzaA__ADX98767

SEQ ID NO: 67539 - RNA, 1701 nt, Artificial Sequence; identical to SEQ ID NO: 65274
  derived and/or modified sequence opt1 from hemagglutinin__InfluenzaA__ADX98777

SEQ ID NO: 67540 - RNA, 1701 nt, Artificial Sequence
  derived and/or modified sequence opt1 from hemagglutinin__InfluenzaA__ADX98785
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcaucgcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucggcggggugaagcuggagagcacccgcaucuaccagauccuggcgaucuacuccaccguggccagcagccucguccugguggugucccugggcgccaucagcuucuggaugugcuccaacggcagccuccagugccggaucugcaucuga

SEQ ID NO: 67541 - RNA, 1701 nt, Artificial Sequence; identical to SEQ ID NO: 64778
  derived and/or modified sequence opt1 from hemagglutinin__InfluenzaA__ADX98792

SEQ ID NO: 67542 - RNA, 1701 nt, Artificial Sequence; identical to SEQ ID NO: 64778
  derived and/or modified sequence opt1 from hemagglutinin__InfluenzaA__ADX98806

SEQ ID NO: 67543 - RNA, 1701 nt, Artificial Sequence; identical to SEQ ID NO: 66718
  derived and/or modified sequence opt1 from hemagglutinin__InfluenzaA__ADX98818

SEQ ID NO: 67544 - RNA, 1701 nt, Artificial Sequence; identical to SEQ ID NO: 63677
  derived and/or modified sequence opt1 from hemagglutinin__InfluenzaA__ADX98828

SEQ ID NO: 67545 - RNA, 1701 nt, Artificial Sequence; identical to SEQ ID NO: 67068
  derived and/or modified sequence opt1 from hemagglutinin__InfluenzaA__ADX98843

SEQ ID NO: 67546 - RNA, 1701 nt, Artificial Sequence
  derived and/or modified sequence opt1 from hemagglutinin__InfluenzaA__ADX98853
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaucgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuaccacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67547 - RNA, 1701 nt, Artificial Sequence; identical to SEQ ID NO: 64841
  derived and/or modified sequence opt1 from hemagglutinin__InfluenzaA__ADX98860

SEQ ID NO: 67548 - RNA, 1701 nt, Artificial Sequence; identical to SEQ ID NO: 66229
  derived and/or modified sequence opt1 from hemagglutinin__InfluenzaA__ADX98870

SEQ ID NO: 67549 - RNA, 1701 nt, Artificial Sequence
  derived and/or modified sequence opt1 from hemagglutinin__InfluenzaA__ADX98880
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccaucaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67550 - RNA, 1701 nt, Artificial Sequence
  derived and/or modified sequence opt1 from hemagglutinin__InfluenzaA__ADX98890
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 67551 - RNA, 1701 nt, Artificial Sequence; identical to SEQ ID NO: 65229
  derived and/or modified sequence opt1 from hemagglutinin__InfluenzaA__ADX98900

SEQ ID NO: 67552 - RNA, 1701 nt, Artificial Sequence
  derived and/or modified sequence opt1 from hemagglutinin__InfluenzaA__ADX98910
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 67553 - RNA, 1701 nt, Artificial Sequence; identical to SEQ ID NO: 65229
  derived and/or modified sequence opt1 from hemagglutinin__InfluenzaA__ADX98920

SEQ ID NO: 67554 - RNA, 1701 nt, Artificial Sequence; identical to SEQ ID NO: 64841
  derived and/or modified sequence opt1 from hemagglutinin__InfluenzaA__ADX98930

SEQ ID NO: 67555 - RNA, 1701 nt, Artificial Sequence; identical to SEQ ID NO: 64468
  derived and/or modified sequence opt1 from hemagglutinin__InfluenzaA__ADX98940

SEQ ID NO: 67556 - RNA, 1701 nt, Artificial Sequence; identical to SEQ ID NO: 66297
  derived and/or modified sequence opt1 from hemagglutinin__InfluenzaA__ADX98950

SEQ ID NO: 67557 - RNA, 1701 nt, Artificial Sequence; identical to SEQ ID NO: 66278
  derived and/or modified sequence opt1 from hemagglutinin__InfluenzaA__ADX98960

SEQ ID NO: 67558 - RNA, 1701 nt, Artificial Sequence
  derived and/or modified sequence opt1 from hemagglutinin__InfluenzaA__ADX98970
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagggccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacaucccgagcauccagucccggggccuguucggggccaucgccggcuucaucgagggcggguggacgggcauggucgacgggugguacggcuaccaccaccagaacgagcaggggagcggcuacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacagcaccguggccuccagccugguccucguggugagccugggcgccaucuccuucuggaugugcagcaacggcucccugcagugccggaucugcaucuga

SEQ ID NO: 67559 - RNA, 1701 nt, Artificial Sequence; identical to SEQ ID NO: 64778
  derived and/or modified sequence opt1 from hemagglutinin__InfluenzaA__ADX98980

SEQ ID NO: 67560 - RNA, 1701 nt, Artificial Sequence; identical to SEQ ID NO: 63677
  derived and/or modified sequence opt1 from hemagglutinin__InfluenzaA__ADX98990

SEQ ID NO: 67561 - RNA, 1701 nt, Artificial Sequence; identical to SEQ ID NO: 64841
  derived and/or modified sequence opt1 from hemagglutinin__InfluenzaA__ADX99000

SEQ ID NO: 67562 - RNA, 1698 nt, Artificial Sequence
  derived and/or modified sequence opt1 from hemagglutinin__InfluenzaA__ADX99581
augaaggccaaccugcucgugcugcugagcgcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacagcgagaacggcaucugcuacccgggcgacuucaucgacuacgaggagcuccgcgagcagcuguccagcguguccagcuucgagcgguucgagaucuuccccaaggaguccagcuggcccaaccacaacaccaacggggugaccgccgccugcucccacgagggcaagagcuccuucuaccgcaaccugcucuggcugaccgagaaggaggggagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucggguccggcaucaucacgagcaacgccuccaugcacgagugcaacaccaagugccagacgccccugggcgccaucaacagcucccugcccuaccagaacauccacccggugaccaucggggagugccccaaguacgugcggagcgccaagcuccgcauggucaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 67563 - RNA, 1698 nt, Artificial Sequence; identical to SEQ ID NO: 67562
  derived and/or modified sequence opt1 from hemagglutinin__InfluenzaA__ADX99592

SEQ ID NO: 67564 - RNA, 1698 nt, Artificial Sequence; identical to SEQ ID NO: 67562
  derived and/or modified sequence opt1 from hemagglutinin__InfluenzaA__ADX99603

SEQ ID NO: 67565 - RNA, 1698 nt, Artificial Sequence
  derived and/or modified sequence opt1 from hemagglutinin__InfluenzaA__ADX99614
augaaggccaaccugcucgugcugcugagcgcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacagcgagaacggcaucugcuacccgggcgacuucaucgacuacgaggagcuccgcgagcagcuguccagcguguccagcuucgagcgguucgagaucuuccccaaggaguccagcuggcccaaccacaacaccaacggggugaccgccgccugcucccacgagggcaagagcuccuucuaccgcaaccugcucuggcugaccgagaagaaggggagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucggguccggcaucaucacgagcaacgccuccaugcacgagugcaacaccaagugccagacgccccugggcgccaucaacagcucccugcccuaccagaacauccacccggugaccaucggggagugccccaaguacgugcggagcgccaagcuccgcauggucaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 67566 - RNA, 1698 nt, Artificial Sequence
  derived and/or modified sequence opt1 from hemagglutinin__InfluenzaA__ADX99625
augaaggccaaccugcucgugcugcugagcgcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacagcgagaacggcaucugcuacccgggcgacuucaucgacuacgaggagcuccgcgagcagcuguccagcguguccagcuucgagcgguucgagaucuuccccaaggaguccagcuggcccaaccacaacaccaacggggugaccgccgccugcucccacgagggcaagagcuccuucuaccgcaaccugcucuggcugaccgagaaggaggggagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucggggccaacggcaaccugaucgcccccauguacgcguucgcccucagccgcggguucggcuccggcaucaucacgagcaacgccuccaugcacgagugcaacaccaagugccagacgccccugggggccaucaacagcucccugcccuaccagaacauccacccggugaccaucggcgagugccccaaguacgugcggagcgccaagcuccgcauggucaccgggcugcggaacacccccuccauccagagccgcggccuguucggggcgaucgccggcuucaucgagggcggguggaccggcaugaucgacgggugguacggcuaccaccaccagaacgagcagggguccggcuacgccgccgaccagaaguccacccagaacgccaucaacggcaucacgaacaaggugaacaccgugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacgcuggacuuccacgacagcaacgucaagaaccuguacgagaaggucaagagccagcucaagaacaacgccaaggagaucgggaacggcugcuucgaguucuaccacaagugcgacaacgagugcauggaguccgugcggaacgggaccuacgacuaccccaaguacagcgaggaguccaagcugaaccgcgagaagguggacggcgugaagcuggagagcaugggcaucuaccagauccucgccaucuacuccaccgucgccagcucccuggugcugcucgugagccugggggcgaucagcuucuggaugugcuccaacggcagccugcagugccggaucugcaucuga

SEQ ID NO: 67567 - RNA, 1698 nt, Artificial Sequence
  derived and/or modified sequence opt1 from hemagglutinin__InfluenzaA__ADX99636
augaaggccaaccugcucgugcugcugagcgcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacagcgagaacggcaucugcuacccgggcgacuucaucgacuacgaggagcuccgcgagcagcuguccagcguguccagcuucgagcgguucgagaucuuccccaaggaguccagcuggcccaaccacaacaccaacggggugaccgccgccugcucccacgagggcaagagcuccuucuaccgcaaccugcucuggcugaccaagaaggaggggagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucggguccggcaucaucacgagcaacgccuccaugcacgagugcaacaccaagugccagacgccccugggcgccaucaacagcucccugcccuaccagaacauccacccggugaccaucggggagugccccaaguacgugcggagcgccaagcuccgcauggucaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 67568 - RNA, 1698 nt, Artificial Sequence; identical to SEQ ID NO: 64286
  derived and/or modified sequence opt1 from hemagglutinin__InfluenzaA__ADX99647

SEQ ID NO: 67569 - RNA, 1698 nt, Artificial Sequence
  derived and/or modified sequence opt1 from hemagglutinin__InfluenzaA__ADX99680
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggagcaaccacaacaccaacggggugaccgccgccugcucccacgagggcaagagcuccuucuaccgcaaccugcucuggcugaccgagaaggaggggagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacagcucccugcccuaccagaacauccaccccgugaccaucggggagugcccgaaguacgugcggagcgccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 67570 - RNA, 1698 nt, Artificial Sequence
  derived and/or modified sequence opt1 from hemagglutinin__InfluenzaA__ADX99702
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaaguccuacgucaacaagaagggcaaggaggugcucgugcugugggggauccaccacccgcccaacagcaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 67571 - RNA, 1698 nt, Artificial Sequence; identical to SEQ ID NO: 67570
  derived and/or modified sequence opt1 from hemagglutinin__InfluenzaA__ADX99843

SEQ ID NO: 67572 - RNA, 1698 nt, Artificial Sequence
  derived and/or modified sequence opt1 from hemagglutinin__InfluenzaA__ADX99854
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccugaagcucaagaacagcuacgucaacaagaagggcaaggaggugcuggugcugugggggauccaccacccgcccaacuccaaggagcagcagaaccucuaccagaacgagaacgcguacgucagcguggugacguccaacuacaaccggcgcuucacccccgagaucgccgagcggcccaagguccgcgaccaggccggccggaugaacuacuacuggacccugcugaagcccggcgacaccaucaucuucgaggccaacgggaaccucaucgccccgauguacgcguucgcccugagccgcggcuucgggagcggcaucaucacguccaacgccagcaugcacgagugcaacaccaagugccagacgccccugggcgccaucaacuccagccuccccuaccagaacauccaccccgugaccaucggggagugcccgaaguacgugcgguccgccaagcugcgcauggucaccggccugcggaacauccccagcauccagucccgcggccucuucggggcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcuggagaagcggauggagaaccugaacaagaagguggacgacggguuccucgacaucuggaccuacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcucgaguccaugggcaucuaccagauccuggccaucuacagcaccgucgccuccagccuggugcuccuggugucccugggcgcgaucagcuucuggaugugcagcaacgggucccugcagugccggaucugcaucuga

SEQ ID NO: 67573 - RNA, 1698 nt, Artificial Sequence
  derived and/or modified sequence opt1 from hemagglutinin__InfluenzaA__ADX99865
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcagaagaacagcuacgucaacaagaagggcaaggaggugcuggugcucugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccugcucaagccgggcgacaccaucaucuucgaggccaacgggaaccugaucgcccccauguacgcguucgcccugagccgcggcuucgggagcggcaucaucacguccaacgccagcaugcacgagugcaacaccaagugccagacgccccucggcgccaucaacuccagccugcccuaccagaacauccacccggugaccaucggggagugccccaaguacgugcgguccgccaagcugcgcauggucaccggccuccggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcgacaacgagugcauggagagcguccggaacggcacguacgacuaccccaaguacuccgaggagagcaagcucaaccgcgagaagguggacggggugaagcuggaguccaugggcaucuaccagauccuggccaucuacagcaccgucgccuccagccucgugcugcuggugucccucggcgcgaucagcuucuggaugugcagcaacgggucccugcagugccggaucugcaucuga

SEQ ID NO: 67574 - RNA, 1698 nt, Artificial Sequence
  derived and/or modified sequence opt1 from hemagglutinin__InfluenzaA__ADX99887
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcuggagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggagcaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacagcucccugcccuaccagaacauccaccccgugaccaucggggagugcccgaaguacgugcggagcgccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 67575 - RNA, 1698 nt, Artificial Sequence
  derived and/or modified sequence opt1 from hemagglutinin__InfluenzaA__ADX99898
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaacuacuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucccgcggcuucgggagcggcaucaucacgagcaacgccuccaugcacgagugcaacaccaagugccagacgccccugggcgccaucaacagcucccugcccuaccagaacauccacccggugaccaucggggagugccccaaguacgugcggagcgccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucuccuucuggaugugcagcaacgggagccugcagugccggaucugcaucuga

SEQ ID NO: 67576 - RNA, 1698 nt, Artificial Sequence
  derived and/or modified sequence opt1 from hemagglutinin__InfluenzaA__ADX99909
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaacuucuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucccgcggcuucgggagcggcaucaucacgagcaacgccuccaugcacgagugcaacaccaagugccagacgccccugggcgccaucaacagcucccugcccuaccagaacauccacccggugaccaucggggagugccccaaguacgugcggagcgccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucuccuucuggaugugcagcaacgggagccugcagugccggaucugcaucuga

SEQ ID NO: 67577 - RNA, 1698 nt, Artificial Sequence; identical to SEQ ID NO: 67576
  derived and/or modified sequence opt1 from hemagglutinin__InfluenzaA__ADX99920

SEQ ID NO: 67578 - RNA, 1698 nt, Artificial Sequence
  derived and/or modified sequence opt1 from hemagglutinin__InfluenzaA__ADX99931
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcuggagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccggccggcccaagguccgcgaccaggccggccggaugaacuacuacuggacccuccugaagccgggggacaccaucaucuucgaggccaacggcaaccugaucgcccccauguacgcguucgcccucagccgcggguucggcagcggcaucaucacguccaacgccagcaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccagcauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacacggugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucgggaaccggugcuucgaguucuaccacaagugcgacaacgagugcauggagagcguccgcaacggcacguacgacuaccccaaguacuccgaggagagcaagcugaaccgggagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccgcaucugcaucuga

SEQ ID NO: 67579 - RNA, 1698 nt, Artificial Sequence
  derived and/or modified sequence opt1 from hemagglutinin__InfluenzaA__ADX99964
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaagcacaacaccaacggggugaccgccgccugcagccacgagggcaaguccagcuucuaccgcaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 67580 - RNA, 1698 nt, Artificial Sequence
  derived and/or modified sequence opt1 from hemagglutinin__InfluenzaA__ADX99975
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgcgaccugcagccacgagggcaaguccagcuucuaccgcaaccugcucuggcugacggagaaggagggguccuaccccgagcugaagaacagcuacgucaacaagaagggcaaggaggugcucgugcugugggggauccaccacccgcccaacuccaaggagcagcagaaccuguaccagaacgagaacgccuacgucagcguggugaccuccaacuacaaccggcgcuucacccccgagaucgccgagcggcccaagguccgcgaccaggccggccggaugaacuacuacuggacccuccugaagccgggcgacacgaucaucuucgaggccaacgggaaccugaucgcccccauguacgccuucgcgcucagccgcggcuucgggagcggcaucaucaccuccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgccaucgcgggguucaucgagggcggcuggaccgggaugaucgacggcugguacggguaccaccaccagaacgagcagggcagcggguacgccgccgaccagaaguccacccagaacgccaucaacggcaucacgaacaaggugaacaccgugaucgagaagaugaacauccaguucaccgccgucggcaaggaguucaacaagcucgagaagcggauggagaaccugaacaagaagguggacgacggguuccuggacaucuggaccuacaacgcggagcuccuggugcugcucgagaacgagcgcacgcuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcaccuacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgccaucagcuucuggaugugcagcaacgggucccugcagugccggaucugcaucuga

SEQ ID NO: 67581 - RNA, 1698 nt, Artificial Sequence
  derived and/or modified sequence opt1 from hemagglutinin__InfluenzaA__ADX99986
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccgaagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcuggagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 67582 - RNA, 1698 nt, Artificial Sequence
  derived and/or modified sequence opt1 from hemagglutinin__InfluenzaA__ADX99997
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcuggagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaaguacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 67583 - RNA, 1698 nt, Artificial Sequence
  derived and/or modified sequence opt1 from hemagglutinin__InfluenzaA__ADY00009
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaagaagggguccuaccccaagcuggagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 67584 - RNA, 1698 nt, Artificial Sequence; identical to SEQ ID NO: 64286
  derived and/or modified sequence opt1 from hemagglutinin__InfluenzaA__ADY00020

SEQ ID NO: 67585 - RNA, 1698 nt, Artificial Sequence
  derived and/or modified sequence opt1 from hemagglutinin__InfluenzaA__ADY04727
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaaccugaagaaccuguacgagaaggugaagucccagcucaagaacaacgcgaaggagaucgggaacggcugcuucgaguucuaccacaagugcaacaacgagugcauggagagcgucaagaacggcaccuacgacuaccccaaguacuccgaggagagcaagcugaaccgggagaagaucgacggggugaagcuggaguccaugggcguguaccagauccucgccaucuacagcacggucgccagcucccuggugcugcucgugagccugggggccaucuccuucuggaugugcagcaacggcucccugcagugccgcaucugcaucuga

SEQ ID NO: 67586 - RNA, 1701 nt, Artificial Sequence; identical to SEQ ID NO: 64621
  derived and/or modified sequence opt1 from hemagglutinin__InfluenzaA__ADY11836

SEQ ID NO: 67587 - RNA, 1701 nt, Artificial Sequence; identical to SEQ ID NO: 64596
  derived and/or modified sequence opt1 from hemagglutinin__InfluenzaA__ADY17654

SEQ ID NO: 67588 - RNA, 1701 nt, Artificial Sequence
  derived and/or modified sequence opt1 from hemagglutinin__InfluenzaA__ADY17665
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagagcuccagcaccggggagaucugcgacagcccccaccagauccucgacggcaagaacugcacccugaucgacgcccugcucggggacccccagugcgacggcuuccagaacaagaagugggaccuguucgucgagcgcagcaaggccuacuccaacugcuaccccuacgacgugccggacuacgcgagccugcggucccucguggccagcuccggcacgcuggaguucaacaacgagagcuucaacuggaccggggucacccaggacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcgggcggaucaccgucuccacgaagcgcagccagcagaccgccaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 67589 - RNA, 1701 nt, Artificial Sequence; identical to SEQ ID NO: 64621
  derived and/or modified sequence opt1 from hemagglutinin__InfluenzaA__ADY17676

SEQ ID NO: 67590 - RNA, 1701 nt, Artificial Sequence
  derived and/or modified sequence opt1 from hemagglutinin__InfluenzaA__ADY17687
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcgccgcgcugcucggcuucaucaugugggccugccagaaggggaacauccggugcaacaucugcaucuga

SEQ ID NO: 67591 - RNA, 1701 nt, Artificial Sequence; identical to SEQ ID NO: 64596
  derived and/or modified sequence opt1 from hemagglutinin__InfluenzaA__ADY17698

SEQ ID NO: 67592 - RNA, 1701 nt, Artificial Sequence
  derived and/or modified sequence opt1 from hemagglutinin__InfluenzaA__ADY38719
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcaagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaagaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgagcgggcggaucacgguguccaccaagcgcagccagcagaccgccaucccgaacaucggcagccggccccgcgugcggaacauccccucccgcaucagcaucuacuggaccaucgucaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagaacacccugaagcucgcgacgggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67593 - RNA, 1701 nt, Artificial Sequence; identical to SEQ ID NO: 63677
  derived and/or modified sequence opt1 from hemagglutinin__InfluenzaA__ADY38750

SEQ ID NO: 67594 - RNA, 1701 nt, Artificial Sequence; identical to SEQ ID NO: 64841
  derived and/or modified sequence opt1 from hemagglutinin__InfluenzaA__ADY38760

SEQ ID NO: 67595 - RNA, 1701 nt, Artificial Sequence
  derived and/or modified sequence opt1 from hemagglutinin__InfluenzaA__ADZ04607
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcgucuaccagauccuggcgaucuacuccaccguggccagcagccuggugcucgucgugucccugggggccaucagcuucuggaugugcuccaacggcagccugcagugccggaucugcaucuga

SEQ ID NO: 67596 - RNA, 1698 nt, Artificial Sequence; identical to SEQ ID NO: 66971
  derived and/or modified sequence opt1 from hemagglutinin__InfluenzaA__ADZ05834

SEQ ID NO: 67597 - RNA, 1698 nt, Artificial Sequence
  derived and/or modified sequence opt1 from hemagglutinin__InfluenzaA__ADZ05845
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacauggccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccagcagccuggugcuccuggucucccugggcgccaucagcuucuggaugugcuccaacgggagccuccagugccggaucugcaucuga

SEQ ID NO: 67598 - RNA, 1701 nt, Artificial Sequence; identical to SEQ ID NO: 63442
  derived and/or modified sequence opt1 from hemagglutinin__InfluenzaA__ADZ05855

SEQ ID NO: 67599 - RNA, 1701 nt, Artificial Sequence
  derived and/or modified sequence opt1 from hemagglutinin__InfluenzaA__ADZ47838
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcuccggcuggcgaccggccugcgcaacguccccagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgggaggagaucgacggcgugaagcuggaguccacccgcaucuaccagauccuggcgaucuacagcaccgucgccagcuccuucgugcucaucgugagccugggggccaucuccuucuggaugugcagcaacggcucccugcagugccggaucugcaucuga

SEQ ID NO: 67600 - RNA, 1701 nt, Artificial Sequence; identical to SEQ ID NO: 64849
  derived and/or modified sequence opt1 from hemagglutinin__InfluenzaA__ADZ47858

SEQ ID NO: 67601 - RNA, 1698 nt, Artificial Sequence
  derived and/or modified sequence opt1 from hemagglutinin__InfluenzaA__ADZ53100
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggagaccugguccuacaucguggagaagcccaaccccgagaacggcacgugcuaccccggccacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccuccaucaacgaccagaagacgcuguaccacaccgagaacgccuacgugagcgucgugagcucccacuacagccggaaguucacccccgagaucgccaagcgccccaaggugcgggaccaggaggggcgcaucaacuacuacuggacccuccuggagccccgggacacgaucaucuucgaggccaacggcaaccugaucgcgccgcgcuacgccuucgcccucucccggggguucggcagcgggaucaucaacuccaacgcccccauggacaagugcgacgccaagugccagacgccccagggcgcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggcuucaucgacaucuggaccuacaacgccgagcugcuggugcuccuggagaacgagcgcacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggggucuaccagauccuggcgaucuacagcacgguggccagcucccuggugcuccuggucagccugggcgccaucuccuucuggaugugcagcaacggcucccuccagugccgcaucugcaucuga

SEQ ID NO: 67602 - RNA, 1701 nt, Artificial Sequence; identical to SEQ ID NO: 64124
  derived and/or modified sequence opt1 from hemagglutinin__InfluenzaA__ADZ53123

SEQ ID NO: 67603 - RNA, 1701 nt, Artificial Sequence; identical to SEQ ID NO: 63919
  derived and/or modified sequence opt1 from hemagglutinin__InfluenzaA__ADZ53125

SEQ ID NO: 67604 - RNA, 1701 nt, Artificial Sequence; identical to SEQ ID NO: 64301
  derived and/or modified sequence opt1 from hemagglutinin__InfluenzaA__ADZ53127

SEQ ID NO: 67605 - RNA, 1701 nt, Artificial Sequence; identical to SEQ ID NO: 63664
  derived and/or modified sequence opt1 from hemagglutinin__InfluenzaA__ADZ53131

SEQ ID NO: 67606 - RNA, 1701 nt, Artificial Sequence; identical to SEQ ID NO: 63677
  derived and/or modified sequence opt1 from hemagglutinin__InfluenzaA__ADZ53133

SEQ ID NO: 67607 - RNA, 1701 nt, Artificial Sequence; identical to SEQ ID NO: 63919
  derived and/or modified sequence opt1 from hemagglutinin__InfluenzaA__ADZ53135

SEQ ID NO: 67608 - RNA, 1701 nt, Artificial Sequence; identical to SEQ ID NO: 64841
  derived and/or modified sequence opt1 from hemagglutinin__InfluenzaA__ADZ53138

SEQ ID NO: 67609 - RNA, 1701 nt, Artificial Sequence; identical to SEQ ID NO: 63677
  derived and/or modified sequence opt1 from hemagglutinin__InfluenzaA__ADZ53140

SEQ ID NO: 67610 - RNA, 1701 nt, Artificial Sequence; identical to SEQ ID NO: 64124
  derived and/or modified sequence opt1 from hemagglutinin__InfluenzaA__ADZ93496

SEQ ID NO: 67611 - RNA, 1689 nt, Artificial Sequence; identical to SEQ ID NO: 63358
  derived and/or modified sequence opt1 from hemagglutinin__InfluenzaA__AEA04365

SEQ ID NO: 67612 - RNA, 1689 nt, Artificial Sequence
  derived and/or modified sequence opt1 from hemagglutinin__InfluenzaA__AEA04376
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacggagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgagaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcgccggcucgagaaccugaacaagaagguggaggacggguuccuggacguguggaccuacaacgccgagcuccugguccugauggagaacgagcgcacgcucgacuuccacgacuccaacgugaagaaccuguacgacaagguccggaugcagcugcgcgacaacgugaaggagcucggcaacgggugcuucgaguucuaccacaagugcgacgacgagugcaugaacagcgugaagaacggcaccuacgacuaccccaaguacgaggaggaguccaagcugaaccggaacgagaucaagggcgucaagcugagcuccauggggguguaccagauccucgccaucuacgccaccguggcgggcagccugucccuggccaucaugauggccgggaucagcuucuggaugugcuccaacggcagccuccagugccgcaucugcaucuga

SEQ ID NO: 67613 - RNA, 1698 nt, Artificial Sequence
  derived and/or modified sequence opt1 from hemagglutinin__InfluenzaA__AEA10292
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugcucccugaagggcaucgcgccccugcagcucgggaacugcagcgucgccggcuggauccuggggaacccggagugcgagcugcucaucuccaaggagagcugguccuacaucguggagaagcccaaccccgagaacgggaccugcuaccccggccacuucgccgacuacgaggagcugcgcgagcagcugagcuccgugagcuccuucgagcgguucgagaucuucccgaaggagagcuccuggcccaaccacacggucaccggggugagcgccuccugcagccacaacggcgaguccagcuucuaccgcaaccuccuguggcugaccgugaagaacgggcucuaccccaaccuguccaagagcuacgccaacaacaaggagaaggagguccuggugcucuggggcgugcaccacccgcccaacaucgucgaccagaagacccuguaccggacggagaacgccuacgugagcguggucuccagccacuacucccgcaaguucacccccgagaucgccaagcggcccaaggugcgcgaccaggaggggcggaucaacuacuacuggacccugcucgagcccggcgacaccaucaucuucgaggccaacggcaaccugaucgcgccgcgcuacgccuucgcccugagccggggguucggcuccgggaucaucaacagcaacgcccccauggacaagugcgacgccaagugccagacgccccgcggcgcgaucaacuccagccuccccuuccagaacgugcacccggucaccaucggcgagugccccaaguacgugcgguccgccaagcugcgcauggugaccgggcugcggaacauccccagcauccagucccgcggccucuucggggccaucgccggcuucaucgagggcggcuggaccggcauggucgacgggugguacggcuaccaccaccagaacgagcaggggagcggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccugaacaagaagguggacgacggcuucaucgacaucuggacguacaacgccgagcuccugguccugcucgagaacgagcggacccuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcuggagagcauggggguguaccagauccucgcgaucuacagcaccgucgccuccagccuggugcugcucgugucccugggcgccaucagcuucuggaugugcuccaacggcagccugcagugccggaucugcaucuga

SEQ ID NO: 67614 - RNA, 1701 nt, Artificial Sequence; identical to SEQ ID NO: 66276
  derived and/or modified sequence opt1 from hemagglutinin__InfluenzaA__AEA10303

SEQ ID NO: 67615 - RNA, 1701 nt, Artificial Sequence; identical to SEQ ID NO: 67130
  derived and/or modified sequence opt1 from hemagglutinin__InfluenzaA__AEA10313

SEQ ID NO: 67616 - RNA, 1701 nt, Artificial Sequence; identical to SEQ ID NO: 64841
  derived and/or modified sequence opt1 from hemagglutinin__InfluenzaA__AEA10323

SEQ ID NO: 67617 - RNA, 1701 nt, Artificial Sequence; identical to SEQ ID NO: 65229
  derived and/or modified sequence opt1 from hemagglutinin__InfluenzaA__AEA10339

SEQ ID NO: 67618 - RNA, 1701 nt, Artificial Sequence
  derived and/or modified sequence opt1 from hemagglutinin__InfluenzaA__AEA10349
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67619 - RNA, 1701 nt, Artificial Sequence; identical to SEQ ID NO: 65274
  derived and/or modified sequence opt1 from hemagglutinin__InfluenzaA__AEA30293

SEQ ID NO: 67620 - RNA, 1701 nt, Artificial Sequence
  derived and/or modified sequence opt1 from hemagglutinin__InfluenzaA__AEA48989
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgcgguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 67621 - RNA, 1707 nt, Artificial Sequence
  derived and/or modified sequence opt1 from hemagglutinin__InfluenzaA__AEA50985
auggagaagaucgugcugcuccuggccaucaucaaccuggucaagagcgaccagaucugcaucggcuaccacgccaacaacuccaccgagcaggucgacaccaucauggagaagaacgugacggugacccacgcgcaggacauccucgagaagacccacaacgggaagcugugcgaccuggacggcgugaagccccucauccugcgcgacugcagcguggccggguggcugcucggcaacccgaugugcgacgaguuccugaacguccccgagugguccuacaucguggagaagaucaaccccgccaacgaccugugcuaccccgggaacuucaacgacuacgaggagcucaagcaccuccugagccggaucaaccacuucgagaagauccagaucaucccgaaguccagcugguccgaccacgaggccagcuccggcgugagcuccgccugccccuaccagggccgcagcuccuucuuccggaacgucguguggcugaucaagaagaacgacgcguaccccaccaucaagaucagcuacaacaacacgaaccaggaggaccugcuggugcucugggggauccaccaccccaacgacgccgccgagcagaccaagcuguaccagaacccgaccaccuacaucuccgucggcacgagcacccugaaccuccgccuggugcccaagaucgccacccgguccaaggugaacgggcagagcggccgcauggaguucuucuggaccauccugaagcccaacgacgcgaucaacuucgaguccaacgggaacuucaucgcccccgagaacgccuacaagaucgucaagaagggcgacagcacgaucaugaaguccgagcucgaguacggcaacugcaacaccaagugccagaccccggugggggccaucaacagcagcaugcccuuccacaacauccacccccugaccaucggcgagugccccaaguacgugaaguccaaccggcugguccucgccacggggcugcgcaacagcccgcagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucaacggggugaccaacaaggucaacagcaucaucgacaagaugaacacccaguucgaggcggugggccgggaguucaacaaccucgagcgccggaucgagaaccugaacaagaagauggaggacggguuccuggacguguggacguacaacgccgagcuccugguccugauggagaacgagcgcacccucgacuuccacgacuccaacgugaagaaccuguacgacaagguccggcugcagcuccgcgacaacgccaaggagcugggcaacggcugcuucgaguucuaccaccggugcgacaacgagugcauggagagcgugcgcaacgggaccuacgacuacccccaguacuccgaggagagccggcugaagcgcgaggagaucuccggcgugaagcucgagagcaucgggaucuaccagauccuguccaucuacagcaccgccgccuccagccuggcgcucgccaucauggucgccggccugucccuguggaugugcagcaacgggagccuccagugccgcaucugcaucuga

SEQ ID NO: 67622 - RNA, 1701 nt, Artificial Sequence; identical to SEQ ID NO: 66541
  derived and/or modified sequence opt1 from hemagglutinin__InfluenzaA__AEA72704

SEQ ID NO: 67623 - RNA, 1701 nt, Artificial Sequence; identical to SEQ ID NO: 66541
  derived and/or modified sequence opt1 from hemagglutinin__InfluenzaA__AEA72715

SEQ ID NO: 67624 - RNA, 1701 nt, Artificial Sequence; identical to SEQ ID NO: 66541
  derived and/or modified sequence opt1 from hemagglutinin__InfluenzaA__AEA72726

SEQ ID NO: 67625 - RNA, 1701 nt, Artificial Sequence
  derived and/or modified sequence opt1 from hemagglutinin__InfluenzaA__AEA72740
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccacccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 67626 - RNA, 1701 nt, Artificial Sequence
  derived and/or modified sequence opt1 from hemagglutinin__InfluenzaA__AEA72750
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcguguucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacaccuacguguucgucggcaccagccgguacuccaagaaguucaagcccgagaucgccauccgcccgaaggugcgggaccaggagggccgcaugaacuacuacuggacccugguggagcccggggacaagaucacguucgaggccaccggcaaccucgucgugccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcucccuggugcucgucgugagccugggggccaucagcuucuggaugugcuccaacggcagccugcagugccggaucugcaucuga

SEQ ID NO: 67627 - RNA, 1701 nt, Artificial Sequence; identical to SEQ ID NO: 67443
  derived and/or modified sequence opt1 from hemagglutinin__InfluenzaA__AEA72759

SEQ ID NO: 67628 - RNA, 1701 nt, Artificial Sequence
  derived and/or modified sequence opt1 from hemagglutinin__InfluenzaA__AEA72777
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacgacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggagauccucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacgcgaccugccagaccccgaagggcgccaucaacaccucccugcccuuccagaacauccaccccaucacgaucgggaagugccccaaguacgucaagagcaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcucaaccgggaggagaucgacggcgugaagcuggagagcacccgcaucuaccagauccuggccaucuacuccaccguggccagcagccucguccugguggugucccugggggccaucagcuucuggaugugcuccaacggcagccuccagugccggaucugcaucuga

SEQ ID NO: 67629 - RNA, 1701 nt, Artificial Sequence; identical to SEQ ID NO: 67443
  derived and/or modified sequence opt1 from hemagglutinin__InfluenzaA__AEA72787

SEQ ID NO: 67630 - RNA, 1701 nt, Artificial Sequence; identical to SEQ ID NO: 66541
  derived and/or modified sequence opt1 from hemagglutinin__InfluenzaA__AEA73288

SEQ ID NO: 67631 - RNA, 1701 nt, Artificial Sequence; identical to SEQ ID NO: 66541
  derived and/or modified sequence opt1 from hemagglutinin__InfluenzaA__AEA73299

SEQ ID NO: 67632 - RNA, 1701 nt, Artificial Sequence; identical to SEQ ID NO: 66541
  derived and/or modified sequence opt1 from hemagglutinin__InfluenzaA__AEA73310

SEQ ID NO: 67633 - RNA, 1701 nt, Artificial Sequence
  derived and/or modified sequence opt1 from hemagglutinin__InfluenzaA__AEA73321
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagagcacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccuggugacccuggagaaccagcacacgaucgaccucaccgacuccgagaugaacaagcuguucgagaagaccaagaagcagcugcgcgagaacgccgaggacauggggaacggcugcuucaccaucuaccacaagugcgacaacgcgugcaucgggagcauccgcaacggcacguacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 67634 - RNA, 1701 nt, Artificial Sequence; identical to SEQ ID NO: 66541
  derived and/or modified sequence opt1 from hemagglutinin__InfluenzaA__AEA73332

SEQ ID NO: 67635 - RNA, 1701 nt, Artificial Sequence; identical to SEQ ID NO: 66541
  derived and/or modified sequence opt1 from hemagglutinin__InfluenzaA__AEA73343

SEQ ID NO: 67636 - RNA, 1701 nt, Artificial Sequence; identical to SEQ ID NO: 66541
  derived and/or modified sequence opt1 from hemagglutinin__InfluenzaA__AEA73354

SEQ ID NO: 67637 - RNA, 1701 nt, Artificial Sequence
  derived and/or modified sequence opt1 from hemagglutinin__InfluenzaA__AEA73365
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaacaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucacgguguccaccaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgucaagcagagcacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgcggaccugaaguccacccaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaccaucuaccacaagugcgacaacgccugcaucgggagcauccgcaacggcacguacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 67638 - RNA, 1701 nt, Artificial Sequence; identical to SEQ ID NO: 66541
  derived and/or modified sequence opt1 from hemagglutinin__InfluenzaA__AEA73376

SEQ ID NO: 67639 - RNA, 1701 nt, Artificial Sequence; identical to SEQ ID NO: 66541
  derived and/or modified sequence opt1 from hemagglutinin__InfluenzaA__AEA73387

SEQ ID NO: 67640 - RNA, 1701 nt, Artificial Sequence; identical to SEQ ID NO: 66541
  derived and/or modified sequence opt1 from hemagglutinin__InfluenzaA__AEA73398

SEQ ID NO: 67641 - RNA, 1701 nt, Artificial Sequence; identical to SEQ ID NO: 66541
  derived and/or modified sequence opt1 from hemagglutinin__InfluenzaA__AEA73409

SEQ ID NO: 67642 - RNA, 1701 nt, Artificial Sequence; identical to SEQ ID NO: 66541
  derived and/or modified sequence opt1 from hemagglutinin__InfluenzaA__AEA73420

SEQ ID NO: 67643 - RNA, 1701 nt, Artificial Sequence; identical to SEQ ID NO: 66541
  derived and/or modified sequence opt1 from hemagglutinin__InfluenzaA__AEA73452

SEQ ID NO: 67644 - RNA, 1701 nt, Artificial Sequence; identical to SEQ ID NO: 66541
  derived and/or modified sequence opt1 from hemagglutinin__InfluenzaA__AEA73463

SEQ ID NO: 67645 - RNA, 1701 nt, Artificial Sequence; identical to SEQ ID NO: 66541
  derived and/or modified sequence opt1 from hemagglutinin__InfluenzaA__AEA73474

SEQ ID NO: 67646 - RNA, 1701 nt, Artificial Sequence
  derived and/or modified sequence opt1 from hemagglutinin__InfluenzaA__AEA73485
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagagcacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 67647 - RNA, 1701 nt, Artificial Sequence; identical to SEQ ID NO: 66541
  derived and/or modified sequence opt1 from hemagglutinin__InfluenzaA__AEA73496

SEQ ID NO: 67648 - RNA, 1701 nt, Artificial Sequence; identical to SEQ ID NO: 66541
  derived and/or modified sequence opt1 from hemagglutinin__InfluenzaA__AEA73507

SEQ ID NO: 67649 - RNA, 1701 nt, Artificial Sequence; identical to SEQ ID NO: 66541
  derived and/or modified sequence opt1 from hemagglutinin__InfluenzaA__AEA73518

SEQ ID NO: 67650 - RNA, 1701 nt, Artificial Sequence; identical to SEQ ID NO: 66541
  derived and/or modified sequence opt1 from hemagglutinin__InfluenzaA__AEA73529

SEQ ID NO: 67651 - RNA, 1701 nt, Artificial Sequence; identical to SEQ ID NO: 66541
  derived and/or modified sequence opt1 from hemagglutinin__InfluenzaA__AEA73540

SEQ ID NO: 67652 - RNA, 1701 nt, Artificial Sequence; identical to SEQ ID NO: 66541
  derived and/or modified sequence opt1 from hemagglutinin__InfluenzaA__AEA73551

SEQ ID NO: 67653 - RNA, 1701 nt, Artificial Sequence; identical to SEQ ID NO: 66541
  derived and/or modified sequence opt1 from hemagglutinin__InfluenzaA__AEA73562

SEQ ID NO: 67654 - RNA, 1698 nt, Artificial Sequence
  derived and/or modified sequence opt1 from hemagglutinin__InfluenzaA__AEA73573
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaucggggaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccggaucugcaucuga

SEQ ID NO: 67655 - RNA, 1698 nt, Artificial Sequence
  derived and/or modified sequence opt1 from hemagglutinin__InfluenzaA__AEA73584
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcaaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 67656 - RNA, 1698 nt, Artificial Sequence
  derived and/or modified sequence opt1 from hemagglutinin__InfluenzaA__AEA73595
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccacacggagaacgccuacgugagcguggucagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccggggcgcgaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccgcaucugcaucuga

SEQ ID NO: 67657 - RNA, 1698 nt, Artificial Sequence; identical to SEQ ID NO: 66961
  derived and/or modified sequence opt1 from hemagglutinin__InfluenzaA__AEA73606

SEQ ID NO: 67658 - RNA, 1698 nt, Artificial Sequence; identical to SEQ ID NO: 64139
  derived and/or modified sequence opt1 from hemagglutinin__InfluenzaA__AEA73617

SEQ ID NO: 67659 - RNA, 1698 nt, Artificial Sequence; identical to SEQ ID NO: 64624
  derived and/or modified sequence opt1 from hemagglutinin__InfluenzaA__AEA73628

SEQ ID NO: 67660 - RNA, 1698 nt, Artificial Sequence; identical to SEQ ID NO: 66980
  derived and/or modified sequence opt1 from hemagglutinin__InfluenzaA__AEA73639

SEQ ID NO: 67661 - RNA, 1698 nt, Artificial Sequence; identical to SEQ ID NO: 64139
  derived and/or modified sequence opt1 from hemagglutinin__InfluenzaA__AEA73650

SEQ ID NO: 67662 - RNA, 1698 nt, Artificial Sequence; identical to SEQ ID NO: 64624
  derived and/or modified sequence opt1 from hemagglutinin__InfluenzaA__AEA73661

SEQ ID NO: 67663 - RNA, 1698 nt, Artificial Sequence
  derived and/or modified sequence opt1 from hemagglutinin__InfluenzaA__AEA73672
augaaggugaagcugcucguccugcugugcaccuucaccgccacguucgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 67664 - RNA, 1698 nt, Artificial Sequence; identical to SEQ ID NO: 64624
  derived and/or modified sequence opt1 from hemagglutinin__InfluenzaA__AEA73683

SEQ ID NO: 67665 - RNA, 1698 nt, Artificial Sequence
  derived and/or modified sequence opt1 from hemagglutinin__InfluenzaA__AEA73694
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcguggagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 67666 - RNA, 1698 nt, Artificial Sequence; identical to SEQ ID NO: 64624
  derived and/or modified sequence opt1 from hemagglutinin__InfluenzaA__AEA73705

SEQ ID NO: 67667 - RNA, 1698 nt, Artificial Sequence; identical to SEQ ID NO: 64139
  derived and/or modified sequence opt1 from hemagglutinin__InfluenzaA__AEA73716

SEQ ID NO: 67668 - RNA, 1698 nt, Artificial Sequence; identical to SEQ ID NO: 64139
  derived and/or modified sequence opt1 from hemagglutinin__InfluenzaA__AEA73727

SEQ ID NO: 67669 - RNA, 1698 nt, Artificial Sequence; identical to SEQ ID NO: 64139
  derived and/or modified sequence opt1 from hemagglutinin__InfluenzaA__AEA73738

SEQ ID NO: 67670 - RNA, 1698 nt, Artificial Sequence; identical to SEQ ID NO: 64139
  derived and/or modified sequence opt1 from hemagglutinin__InfluenzaA__AEA73749

SEQ ID NO: 67671 - RNA, 1698 nt, Artificial Sequence
  derived and/or modified sequence opt1 from hemagglutinin__InfluenzaA__AEA73760
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucacccccgagaucgccaagcggcccaagauccgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggucaacagcgugaucgagaagaugaacacccaguucaccgccgucggcaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccauggggguguaccagauccuggcgaucuacagcaccguggccagcucccugguccuccuggugagccugggcgccaucuccuucuggaugugcagcaacggcucccuccagugccggaucugcaucuga

SEQ ID NO: 67672 - RNA, 1701 nt, Artificial Sequence; identical to SEQ ID NO: 63677
  derived and/or modified sequence opt1 from hemagglutinin__InfluenzaA__AEA73771

SEQ ID NO: 67673 - RNA, 1701 nt, Artificial Sequence; identical to SEQ ID NO: 65307
  derived and/or modified sequence opt1 from hemagglutinin__InfluenzaA__AEA73781

SEQ ID NO: 67674 - RNA, 1701 nt, Artificial Sequence; identical to SEQ ID NO: 65229
  derived and/or modified sequence opt1 from hemagglutinin__InfluenzaA__AEA73791

SEQ ID NO: 67675 - RNA, 1701 nt, Artificial Sequence; identical to SEQ ID NO: 63857
  derived and/or modified sequence opt1 from hemagglutinin__InfluenzaA__AEA73801

SEQ ID NO: 67676 - RNA, 1701 nt, Artificial Sequence; identical to SEQ ID NO: 64841
  derived and/or modified sequence opt1 from hemagglutinin__InfluenzaA__AEA73811

SEQ ID NO: 67677 - RNA, 1701 nt, Artificial Sequence; identical to SEQ ID NO: 65399
  derived and/or modified sequence opt1 from hemagglutinin__InfluenzaA__AEA73821

SEQ ID NO: 67678 - RNA, 1701 nt, Artificial Sequence
  derived and/or modified sequence opt1 from hemagglutinin__InfluenzaA__AEA73831
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgcggccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccaccgaccagcagagccuguaccagaacgcggacgccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 67679 - RNA, 1701 nt, Artificial Sequence
  derived and/or modified sequence opt1 from hemagglutinin__InfluenzaA__AEA73841
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgaguccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucguggagaagaugaacacccaguucacggccgucgggaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaacgggagccugcagugccggaucugcaucuga

SEQ ID NO: 67680 - RNA, 1701 nt, Artificial Sequence; identical to SEQ ID NO: 65307
  derived and/or modified sequence opt1 from hemagglutinin__InfluenzaA__AEA73851

SEQ ID NO: 67681 - RNA, 1701 nt, Artificial Sequence
  derived and/or modified sequence opt1 from hemagglutinin__InfluenzaA__AEA73861
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67682 - RNA, 1701 nt, Artificial Sequence; identical to SEQ ID NO: 65549
  derived and/or modified sequence opt1 from hemagglutinin__InfluenzaA__AEA73871

SEQ ID NO: 67683 - RNA, 1701 nt, Artificial Sequence; identical to SEQ ID NO: 65549
  derived and/or modified sequence opt1 from hemagglutinin__InfluenzaA__AEA73881

SEQ ID NO: 67684 - RNA, 1701 nt, Artificial Sequence; identical to SEQ ID NO: 65229
  derived and/or modified sequence opt1 from hemagglutinin__InfluenzaA__AEA73891

SEQ ID NO: 67685 - RNA, 1701 nt, Artificial Sequence
  derived and/or modified sequence opt1 from hemagglutinin__InfluenzaA__AEA73901
augaacgccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaagaucaacuccgugaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgucaagcuggagagcacccgcaucuaccagauccuggcgaucuacuccaccguggccagcagccucgugcuggucgugucccugggggccaucagcuucuggaugugcuccaacggcagccuccagugccggaucugcaucuga

SEQ ID NO: 67686 - RNA, 1701 nt, Artificial Sequence; identical to SEQ ID NO: 64841
  derived and/or modified sequence opt1 from hemagglutinin__InfluenzaA__AEA73911

SEQ ID NO: 67687 - RNA, 1701 nt, Artificial Sequence; identical to SEQ ID NO: 65549
  derived and/or modified sequence opt1 from hemagglutinin__InfluenzaA__AEA73921

SEQ ID NO: 67688 - RNA, 1701 nt, Artificial Sequence; identical to SEQ ID NO: 65307
  derived and/or modified sequence opt1 from hemagglutinin__InfluenzaA__AEA73931

SEQ ID NO: 67689 - RNA, 1701 nt, Artificial Sequence; identical to SEQ ID NO: 65307
  derived and/or modified sequence opt1 from hemagglutinin__InfluenzaA__AEA73961

SEQ ID NO: 67690 - RNA, 1701 nt, Artificial Sequence
  derived and/or modified sequence opt1 from hemagglutinin__InfluenzaA__AEA73971
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccagaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcaacaacacgugcauggaguccgugaagaacgggaccuacgacuacccgaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 67691 - RNA, 1701 nt, Artificial Sequence; identical to SEQ ID NO: 65307
  derived and/or modified sequence opt1 from hemagglutinin__InfluenzaA__AEA73981

SEQ ID NO: 67692 - RNA, 1701 nt, Artificial Sequence
  derived and/or modified sequence opt1 from hemagglutinin__InfluenzaA__AEA73991
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgcuacuccaagaaguucaagcccgagaucgccauccggccgaagguccgcgaccaggagggccggaugaacuacuacuggacccugguggagcccggggacaagaucaccuucgaggccaccggcaaccucguggucccccgcuacgcguucgccauggagcggaacgccgggagcggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 67693 - RNA, 1701 nt, Artificial Sequence; identical to SEQ ID NO: 65290
  derived and/or modified sequence opt1 from hemagglutinin__InfluenzaA__AEA74001

SEQ ID NO: 67694 - RNA, 1701 nt, Artificial Sequence
  derived and/or modified sequence opt1 from hemagglutinin__InfluenzaA__AEA74011
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagcggaacagcuaccccaagcugucccagagcuacaucaacgacaaggggaaggaggugcugguccucuggggcauccaccaccccagcaccuccgccgaccagcagagccuguaccagaacgccgacgccuacguguucguggggacgucccgcuacagcaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcaucaagaacggcaccuacgacuaccccaaguacuccgaggaggccaagcugaaccgcgaggagaucgacggggugaagcucgagagcacccggaucuaccagauccuggcgaucuacuccaccguggccagcagccugguccucguggugucccugggcgccaucagcuucuggaugugcuccaacgggagccugcagugccgcaucugcaucuga

SEQ ID NO: 67695 - RNA, 1701 nt, Artificial Sequence
  derived and/or modified sequence opt1 from hemagglutinin__InfluenzaA__AEA74021
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcaucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67696 - RNA, 1701 nt, Artificial Sequence
  derived and/or modified sequence opt1 from hemagglutinin__InfluenzaA__AEA74031
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaacaaccugaucuggcucgugaagaaggggaacagcuaccccaagcugaacaaguccuacaucaacgacaagggcaaggaggugcugguccucugggggauccaccaccccagcaccagcacggaccagcagucccuguaccagaacgccgacgccuacguguucgugggcaccagccgguacuccaagaaguucaagcccgagaucgccauccgcccgaagguccggaaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccauccacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacgagaucaccaacaaggugaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggcguccagccugguccucguggugagccugggggccaucuccuucuggaugugcagcaacggcucccugcagugccggaucugcaucuga

SEQ ID NO: 67697 - RNA, 1701 nt, Artificial Sequence
  derived and/or modified sequence opt1 from hemagglutinin__InfluenzaA__AEA74035
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaacaaccugaucuggcucgugaagaaggggaacagcuaccccaagcugaacaaguccuacaucaacgacaagggcaaggaggugcugguccucugggggauccaccaccccagcaccagcacggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccauccacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacgagaucaccaacaaggugaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacagcaccguggcguccagccugguccucguggugagccugggggccaucuccuucuggaugugcagcaacggcucccugcagugccggaucugcaucuga

SEQ ID NO: 67698 - RNA, 1701 nt, Artificial Sequence; identical to SEQ ID NO: 63442
  derived and/or modified sequence opt1 from hemagglutinin__InfluenzaA__AEA77299

SEQ ID NO: 67699 - RNA, 1701 nt, Artificial Sequence; identical to SEQ ID NO: 67443
  derived and/or modified sequence opt1 from hemagglutinin__InfluenzaA__AEB21316

SEQ ID NO: 67700 - RNA, 1701 nt, Artificial Sequence; identical to SEQ ID NO: 67462
  derived and/or modified sequence opt1 from hemagglutinin__InfluenzaA__AEB21326

SEQ ID NO: 67701 - RNA, 1701 nt, Artificial Sequence; identical to SEQ ID NO: 67443
  derived and/or modified sequence opt1 from hemagglutinin__InfluenzaA__AEB21338

SEQ ID NO: 67702 - RNA, 1701 nt, Artificial Sequence; identical to SEQ ID NO: 67462
  derived and/or modified sequence opt1 from hemagglutinin__InfluenzaA__AEB21348

SEQ ID NO: 67703 - RNA, 1701 nt, Artificial Sequence; identical to SEQ ID NO: 64596
  derived and/or modified sequence opt1 from hemagglutinin__InfluenzaA__AEB40206

SEQ ID NO: 67704 - RNA, 1701 nt, Artificial Sequence; identical to SEQ ID NO: 64596
  derived and/or modified sequence opt1 from hemagglutinin__InfluenzaA__AEB66895

SEQ ID NO: 67705 - RNA, 1698 nt, Artificial Sequence
  derived and/or modified sequence opt1 from hemagglutinin__InfluenzaA__AEB71102
auggacgugcccgucuucgugcugcucaugcugaccagcaucugcgugcaggccgaccgcaucugcgucggcuaccuguccaccaacagcuccgagcggguggacacgcuccuggagaacaacgugccggucaccagcuccguggaccugguggagaccaaccacaccgggacguacugcagccucggcgggaucucccccguccaccugggcgacugcagcuucgagggguggaucgugggcaaccccgccugcgcguccaaccugggcauccgcgaguggagcuaccucaucgaggaccccuccgccccgcacgggcugugcuaccccggcgagcuggacaacaacggggagcuccggcaccuguucagcggcauccgcuccuucagccggaccgagcugaucgcccccaccuccuggggcgaggugaacgacggggucaccgccgccugccaggacaagggcgcgagcuccuucuaccgcaaccucgugugguucguggagcgggggaacaaguaccccgucauccgccggacguacaacaacaccaccggccgcgacgugcuggugaucugggggauccaccacccggucagcaccgacgaggcccggaagcuguacgccaaggacaaccccuacacgcucguguccaccagcagcuggucccgcaaguacaaccuggagaccggcacccggcccggcuacaacgggcagaaguccuggacgaagaucuacugguaccugaugcaccccggcgacagcaucagcuucgaguccaacgggggccuccuggccccgaaguacggguacaucaucgaggaguacggcaagggccgcaucuuccagagccggauccgcaucgcgaagugcaacaccaagugccagaccuccgucgggggcaucaacaccaacaagacguuccagaacaucgagcggaacgcccugggggacugccccaaguacaucaagagcggccagcucaagcuggccaccgggcugcgcaacgugcccgccaucuccaaccggggccucuucggcgccaucgcgggguucaucgagggcggguggcccggccugaucaacgggugguacggcuuccagcaccagaacgagcagggcauggggauggccgccgacaaggagagcacccagaaggccaucgaccagaucaccacgaagaucaacaacaucaucgagaagaugaacggcaacuacgacuccauccgcggggaguucagccagguggagcagcggaucaacaugcuggccgaccgcaucgacgacgcggugaccgacgucugguccuacaacgccaagcuccuggugcugcucgagaacgacaagacccuggacaugcacgacgccaacguccgcaaccugcacgaccaggugcggcgcgugcuccggaccaacgccaucgacgagggcaacggcugcuucgagcugcugcacaagugcaacgacagcugcauggagacgauccgcaacgggaccuacaaccacaucgaguacgaggaggaguccaagcucaagcggcaggagaucgagggcaucaagcucaagagcgacgacaacgucuacaaggcccuguccaucuacagcugcaucgcguccagcaucgugcugguggggcugauccuggccuucaucaugugggccugcagcuccggcaacugccgcuucaacaucugcaucuga

SEQ ID NO: 67706 - RNA, 1698 nt, Artificial Sequence
  derived and/or modified sequence opt1 from hemagglutinin__InfluenzaA__AEB71896
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaacaaggagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 67707 - RNA, 1701 nt, Artificial Sequence; identical to SEQ ID NO: 63919
  derived and/or modified sequence opt1 from hemagglutinin__InfluenzaA__AEB71916

SEQ ID NO: 67708 - RNA, 1701 nt, Artificial Sequence; identical to SEQ ID NO: 63442
  derived and/or modified sequence opt1 from hemagglutinin__InfluenzaA__AEB71925

SEQ ID NO: 67709 - RNA, 1701 nt, Artificial Sequence; identical to SEQ ID NO: 63442
  derived and/or modified sequence opt1 from hemagglutinin__InfluenzaA__AEB71936

SEQ ID NO: 67710 - RNA, 1701 nt, Artificial Sequence; identical to SEQ ID NO: 63442
  derived and/or modified sequence opt1 from hemagglutinin__InfluenzaA__AEB71947

SEQ ID NO: 67711 - RNA, 1698 nt, Artificial Sequence; identical to SEQ ID NO: 66980
  derived and/or modified sequence opt1 from hemagglutinin__InfluenzaA__AEB71958

SEQ ID NO: 67712 - RNA, 1701 nt, Artificial Sequence; identical to SEQ ID NO: 66427
  derived and/or modified sequence opt1 from hemagglutinin__InfluenzaA__AEB71969

SEQ ID NO: 67713 - RNA, 1701 nt, Artificial Sequence
  derived and/or modified sequence opt1 from hemagglutinin__InfluenzaA__AEB71980
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67714 - RNA, 1698 nt, Artificial Sequence; identical to SEQ ID NO: 64624
  derived and/or modified sequence opt1 from hemagglutinin__InfluenzaA__AEB71992

SEQ ID NO: 67715 - RNA, 1698 nt, Artificial Sequence; identical to SEQ ID NO: 64624
  derived and/or modified sequence opt1 from hemagglutinin__InfluenzaA__AEC13313

SEQ ID NO: 67716 - RNA, 1701 nt, Artificial Sequence
  derived and/or modified sequence opt1 from hemagglutinin__InfluenzaA__AEC46553
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaccuccuacaucaacgacaagggcaaggaggugcugguccucugggggauccaccaccccagcacgagcgccgaccagcagucccuguaccagaacgccgacgccuacgccuucgugggcaccagccgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccgggagcggcaucaucaucuccgacaccagcguccacgacugcaacacgaccugccagaccccgaagggcgcgaucaacaccucccugcccuuccagaacgugcaccccaucaccaucgggaagugccccaaguacgucaagagcaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccuucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 67717 - RNA, 1701 nt, Artificial Sequence
  derived and/or modified sequence opt1 from hemagglutinin__InfluenzaA__AEC46555
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaccuccuacaucaacgacaagggcaagaaggugcugguccucugggggauccaccaccccagcacgagcgccgaccagcagucccuguaccagaacgccgacgccuacgccuucgugggcaccagccgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgaggggagcggcaucaucaucuccgacaccagcguccacgacugcaacacgaccugccagaccccgaagggcgccaucaacaccucccugcccuuccagaacgugcaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcguucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67718 - RNA, 1701 nt, Artificial Sequence; identical to SEQ ID NO: 67716
  derived and/or modified sequence opt1 from hemagglutinin__InfluenzaA__AEC46557

SEQ ID NO: 67719 - RNA, 1701 nt, Artificial Sequence; identical to SEQ ID NO: 63664
  derived and/or modified sequence opt1 from hemagglutinin__InfluenzaA__AEC53259

SEQ ID NO: 67720 - RNA, 1701 nt, Artificial Sequence
  derived and/or modified sequence opt1 from hemagglutinin__InfluenzaA__AEC53269
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcugcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcucguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcuccggcuggcgaccggccugcgcaacaucccgagcauccagucccggggccucuucggggccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacagcgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacagcaccguggccagcucccucguccugguggugagccugggggccaucuccuucuggaugugcagcaacggcucccuccagugccggaucugcaucuga

SEQ ID NO: 67721 - RNA, 1701 nt, Artificial Sequence; identical to SEQ ID NO: 64407
  derived and/or modified sequence opt1 from hemagglutinin__InfluenzaA__AEC53279

SEQ ID NO: 67722 - RNA, 1701 nt, Artificial Sequence; identical to SEQ ID NO: 63664
  derived and/or modified sequence opt1 from hemagglutinin__InfluenzaA__AEC53289

SEQ ID NO: 67723 - RNA, 1701 nt, Artificial Sequence; identical to SEQ ID NO: 63664
  derived and/or modified sequence opt1 from hemagglutinin__InfluenzaA__AEC53299

SEQ ID NO: 67724 - RNA, 1701 nt, Artificial Sequence; identical to SEQ ID NO: 63857
  derived and/or modified sequence opt1 from hemagglutinin__InfluenzaA__AEC53327

SEQ ID NO: 67725 - RNA, 1701 nt, Artificial Sequence
  derived and/or modified sequence opt1 from hemagglutinin__InfluenzaA__AEC53347
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugaucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 67726 - RNA, 1701 nt, Artificial Sequence
  derived and/or modified sequence opt1 from hemagglutinin__InfluenzaA__AEC53404
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcuggucaagaaggggaacagcuaccccaagcucuccaagagcuacaucaacgacaagggcaaggaggugcuggugcugugggggauccaccaccccagcaccuccgccgaccagcagagccucuaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccugguggugccccgguacgccuucgccauggagcgcaacgccgggagcggcaucaucaucuccgacacccccguccacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgugccgagcauccagucccgggggcuguucggcgccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgcgaucuacagcaccguggccagcucccugguccugguggugagccucggggccaucuccuucuggaugugcagcaacggcucccugcagugccggaucugcaucuga

SEQ ID NO: 67727 - RNA, 1701 nt, Artificial Sequence; identical to SEQ ID NO: 63664
  derived and/or modified sequence opt1 from hemagglutinin__InfluenzaA__AEC53414

SEQ ID NO: 67728 - RNA, 1701 nt, Artificial Sequence
  derived and/or modified sequence opt1 from hemagglutinin__InfluenzaA__AEE27177
augaagaccauccuggugguccuccuguacaccuucgccacggccaacgcggacacccugugcaucggcuaccacgccaacaacagcaccgacaccguggacacggugcucgagaagaacgucaccgugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagacguccagcuccgacaacgggaccugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcuggugaagaaggggaacagcuaccccaagcucuccaagagcuacaucaacgacaagcggaaggaggugcugguccuguggggcauccaccaccccagcacguccgcggaccagcagagccucuaccagaacgccgacgccuacguguucgugggguccagccgcuacuccaagaaguucaagcccgagaucgccauccggccgaagguccgcgaccaggagggccggaugaacuacuacuggacccugguggagcccggcgacaagaucaccuucgaggccaccgggaaccugguggucccccgcuacgcguucgccauggagcggaacgccggcagcgggaucaucaucuccgacacgcccgugcacgacugcaacacgaccugccagaccccgaagggcgccaucaacaccagccuccccuuccagaacauccaccccaucaccaucggcaagugccccaaguacgugaaguccaccaagcugcgccuggccaccgggcuccggaacgucccgagcauccagucccgcggccuguucggggcgaucgccggcuucaucgagggcggcuggacgggcaugguggacgggugguacggcuaccaccaccagaacgagcaggggagcggcuacgccgccgaccugaaguccacccagaacgccaucgacgagaucaccaacaaggugaacagcgucaucgagaagaugaacacccaguucacggcgguggggaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgugaagaaccuguacgagaagguccggagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcuggaguccacccggaucuaccagauccucgccaucuacagcaccgucgcgagcucccuggugcugguggucagccucggcgccaucuccuucuggaugugcagcaacgggucccugcagugccgcaucugcaucuga

SEQ ID NO: 67729 - RNA, 1701 nt, Artificial Sequence; identical to SEQ ID NO: 65449
  derived and/or modified sequence opt1 from hemagglutinin__InfluenzaA__AEE27187

SEQ ID NO: 67730 - RNA, 1701 nt, Artificial Sequence
  derived and/or modified sequence opt1 from hemagglutinin__InfluenzaA__AEE27207
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaaggugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67731 - RNA, 1701 nt, Artificial Sequence
  derived and/or modified sequence opt1 from hemagglutinin__InfluenzaA__AEG64752
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugcgguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggcgccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67732 - RNA, 1701 nt, Artificial Sequence
  derived and/or modified sequence opt1 from hemagglutinin__InfluenzaA__AEG64762
augaaggcccgccugcucgugcugcugugcgcccucgcggccaccgacgccgacaccaucugcaucggcuaccacgccaacaacagcacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggagcugguccuacaucguggagacccccaacagcgagaacggcgccugcuaccccggcgacuucaucgacuacgaggagcugcgcgagcagcuguccaccgugagcucccucgagcgguucgagaucuucccgaaggagagcuccuggcccaaccacaacacccugaagggggucacggugagcugcucccacggcggcaagagcuccuucuaccgcaaccugcucuggcugaccaagaccggggacagcuaccccaagcugaacaacuccuacgugaacaacaaggggaaggagguccucgugcuguggggcgugcaccaccccagcuccagcaacgagcagcagagccuguaccacaacgucaacgccuacguguccguggucagcuccaacuacaaccggcgcuucaccccggagaucgcggcccggcccaaggugcgcgaccagcccggccggaugaacuacuacuggacgcuccuggagcccggggacaccauccuguucgaggccaccggcaaccucaucgccccgugguacgccuucgcgcugagccgcggguucggcuccggcaucaucaccagcaacgccuccaugcacgagugcaacacgaagugccagacgccccagggggccaucaacagcucccugcccuuccagaacauccaccccgugaccaucggcgagugcccgaaguacguccggagcaccaagcuccgcauggugaccgggcugcggaacauccccuccauccagagccgcggccuguucggggccaucgccggcuucaucgagggcggguggaccggcaugaucgacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaaccucgagaagcggauggagaaccugaacaagaagguggacgacggcuuccuggacaucuggaccuacaacgccgagcuccugguccugcucgagaacgagcgcacccuggacuuccacgaccugaacgugaagaaccucuacgagaaggucaagagccagcugaagaacaacgcgaaggagaucgggaacggcugcuucgaguucuaccacaagugcgacaacgagugcauggaguccgugcgggacgggacguacgacuaccccaaguacagcgaggaguccaagcugaaccgcgagaagaucgacggcgugaagcucgagagcaugggcgucuaccagauccuggccaucuacagcaccguggccuccagccuggugcugcucgucucccugggggccaucagcuucuggaugugcuccaacggcagccugcagugccggaucugcaucuga

SEQ ID NO: 67733 - RNA, 1701 nt, Artificial Sequence; identical to SEQ ID NO: 63677
  derived and/or modified sequence opt1 from hemagglutinin__InfluenzaA__AEG64784

SEQ ID NO: 67734 - RNA, 1701 nt, Artificial Sequence
  derived and/or modified sequence opt1 from hemagglutinin__InfluenzaA__AEG64834
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccgccggggagaucugcgacagcccccaccagauccucgacggcgagaacugcacccugaucgacgcccugcucggggacccccagugcgacggcuuccagaacaagaagugggaccuguucguggagcgcucccgggcguacagcaacugcuaccccuacgacgugccggacuacgccucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcgcaucaccgugagcaccaagcggucccagcaggccgugaucccgaacaucggcagccgcccccggguccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcgcccaucgggaagugcaacuccgagugcaucacccccaacggcagcauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgccaucgccggguucaucgagaacggcugggagggcaugguggacgggugguacggcuuccggcaccagaacagcgaggggcgcggccaggcggccgaccugaaguccacccaggccgccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 67735 - RNA, 1701 nt, Artificial Sequence
  derived and/or modified sequence opt1 from hemagglutinin__InfluenzaA__AEG64845
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 67736 - RNA, 1701 nt, Artificial Sequence
  derived and/or modified sequence opt1 from hemagglutinin__InfluenzaA__AEG64856
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcgugaugcgguccgacgccagcaucggcaagugcaacuccgagugcaucaccccgaacggcagcauccccaacgacaagcccuuccagaacgugaaccgcaucaccuacggggccugcccccgguacgucaagcagaacacgcucaagcuggccaccggcaugcgcaacgugccggagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucgagagcauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcugugcgucgugcuccugggguucaucaugugggccugccagaagggcaacauccggugcaacaucugcaucuga

SEQ ID NO: 67737 - RNA, 1701 nt, Artificial Sequence; identical to SEQ ID NO: 61080
  derived and/or modified sequence opt1 from hemagglutinin__InfluenzaA__AEG64867

SEQ ID NO: 67738 - RNA, 1701 nt, Artificial Sequence
  derived and/or modified sequence opt1 from hemagglutinin__InfluenzaA__AEG64878
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcaucgggcaggccgcggaccugaaguccacgcaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 67739 - RNA, 1701 nt, Artificial Sequence
  derived and/or modified sequence opt1 from hemagglutinin__InfluenzaA__AEG64889
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccuguucgccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgugacgaugcccaacaacgagaaguucgacaagcuguacaucuggggcguccaccaccccagcaccgacuccgaccagaucagccuguacgcccaggccagcgggcgcgugaccguguccaccaagcggagccagcagacggucaucccgaacaucggcucccgccccugggugcgcggggugagcucccggaucagcaucuacuggaccaucgucaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagaagacccggaagcagcuccgcgagaacgcggaggacaugggcaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggguucaucaugugggccugccagaagggcaacauccggugcaacaucugcaucuga

SEQ ID NO: 67740 - RNA, 1701 nt, Artificial Sequence; identical to SEQ ID NO: 61040
  derived and/or modified sequence opt1 from hemagglutinin__InfluenzaA__AEG64911

SEQ ID NO: 67741 - RNA, 1701 nt, Artificial Sequence; identical to SEQ ID NO: 61040
  derived and/or modified sequence opt1 from hemagglutinin__InfluenzaA__AEG64922

SEQ ID NO: 67742 - RNA, 1701 nt, Artificial Sequence; identical to SEQ ID NO: 61040
  derived and/or modified sequence opt1 from hemagglutinin__InfluenzaA__AEG64933

SEQ ID NO: 67743 - RNA, 1701 nt, Artificial Sequence; identical to SEQ ID NO: 61126
  derived and/or modified sequence opt1 from hemagglutinin__InfluenzaA__AEG64944

SEQ ID NO: 67744 - RNA, 1701 nt, Artificial Sequence; identical to SEQ ID NO: 61040
  derived and/or modified sequence opt1 from hemagglutinin__InfluenzaA__AEG64955

SEQ ID NO: 67745 - RNA, 1701 nt, Artificial Sequence; identical to SEQ ID NO: 61040
  derived and/or modified sequence opt1 from hemagglutinin__InfluenzaA__AEG64966

SEQ ID NO: 67746 - RNA, 1701 nt, Artificial Sequence
  derived and/or modified sequence opt1 from hemagglutinin__InfluenzaA__AEG64977
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgggaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucgacuggaccggggugacccagaacggcaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcgggcggaucaccgugagcacgaagcgcucccagcagaccgugaucccgaacaucggcagccggccccgcguccgggacguguccagccgcaucuccaucuacuggaccaucgugaagcccggcgacauccugcucaucaacagcaccgggaaccugaucgcgccccggggcuacuucaagauccgcuccgggaaguccuccaucaugcggagcgacgccccgaucgacaagugcaacuccgagugcaucacgcccaacggcagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacuccgagggcaccgggcaggccgccgaccucaagagcacccaggcggccaucaaccagaucaacggcaagcugaaccggcugaucgggaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaagggcaacauccggugcaacaucugcaucuga

SEQ ID NO: 67747 - RNA, 1701 nt, Artificial Sequence
  derived and/or modified sequence opt1 from hemagglutinin__InfluenzaA__AEG64988
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacaugccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgugguccugcucggcuucaucaugugggccugccagaaggggaacauccggugcaacaucugcaucuga

SEQ ID NO: 67748 - RNA, 1701 nt, Artificial Sequence
  derived and/or modified sequence opt1 from hemagglutinin__InfluenzaA__AEG64999
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgucucccugcggagccucguggcguccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgucaccaugcccaacaacgagaaguucgacaagcucuacaucuggggcgugcaccaccccgggaccgacaacgaccagaucucccuguacgcccaggcgagcggccggaucaccguguccacgaagcgcagccagcagaccgucaucccgaacaucggcagccggccccgcgugcgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacagcgagggcaucgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcgcucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 67749 - RNA, 1701 nt, Artificial Sequence; identical to SEQ ID NO: 61263
  derived and/or modified sequence opt1 from hemagglutinin__InfluenzaA__AEG65010

SEQ ID NO: 67750 - RNA, 1701 nt, Artificial Sequence
  derived and/or modified sequence opt1 from hemagglutinin__InfluenzaA__AEG65021
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucagccugcggucccucguggcgagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaccgagaaguucgacaagcucuacaucuggggcgugcaccaccccgggaccgacaacgaccagaucagccuguacgcccaggcguccggccggaucacggugagcaccaagcgcagccagcagaccgucaucccgaacaucggcucccggccccgcgugcgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 67751 - RNA, 1701 nt, Artificial Sequence
  derived and/or modified sequence opt1 from hemagglutinin__InfluenzaA__AEG65032
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaacaagcucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 67752 - RNA, 1701 nt, Artificial Sequence; identical to SEQ ID NO: 61638
  derived and/or modified sequence opt1 from hemagglutinin__InfluenzaA__AEG65043

SEQ ID NO: 67753 - RNA, 1701 nt, Artificial Sequence; identical to SEQ ID NO: 61638
  derived and/or modified sequence opt1 from hemagglutinin__InfluenzaA__AEG65054

SEQ ID NO: 67754 - RNA, 1701 nt, Artificial Sequence
  derived and/or modified sequence opt1 from hemagglutinin__InfluenzaA__AEG65065
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacugggugcuguggaucuccuucgccaucagcugcuuccuccugugcgucgugcugcucggcuucaucaugugggccugccagaaggggaacauccggugcaacaucugcaucuga

SEQ ID NO: 67755 - RNA, 1701 nt, Artificial Sequence
  derived and/or modified sequence opt1 from hemagglutinin__InfluenzaA__AEG65076
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccuccgguucaaguaccccgcccugaacgugaccaugcccaacaacgagaaguucgacaagcuguacaucuggggcguccaccaccccgggaccgacaacgaccagaucuuccuguacgcgcaggccagcggccgcaucaccguguccacgaagcggagccagcagaccgugaucccgaacgucggcagccgcccccgggugcgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 67756 - RNA, 1701 nt, Artificial Sequence
  derived and/or modified sequence opt1 from hemagglutinin__InfluenzaA__AEG65087
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 67757 - RNA, 1701 nt, Artificial Sequence
  derived and/or modified sequence opt1 from hemagglutinin__InfluenzaA__AEG65098
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacgacuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggcgugacccagaacgggaccuccagcgccugcaagcgccgguccaacaacagcuucuucucccgccugaacuggcucacgcacagcaaguucaaguaccccgcccugaacgugaccaugcccaacaacgagaaguucgacaagcuguacaucuggggcguccaccaccccgggaccgacaacgaccagaucuuccucuacgcgcaggccuccggccggaucaccgugagcacgaagcgcagccagcagaccgugaucccgaacaucgggucccggccccgcguccggaacauccccagccgcaucuccaucuacuggaccaucgugaagcccggcgacauccugcugaucaacagcaccggcaaccucaucgccccgcggggguacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacgggugggagggcaugguggacggcugguacggguuccgccaccagaacuccgagggcaucgggcaggccgccgaccucaagagcacccaggcggccaucaaccagaucaacggcaaccugaaccggcugaucgggaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggguacaaggacuggauccuguggaucagcuucgccaucuccugcuuccugcucugcgugguccugcugggcuucaucaugugggccugccagaagggcaacauccggugcaacaucugcaucuga

SEQ ID NO: 67758 - RNA, 1701 nt, Artificial Sequence
  derived and/or modified sequence opt1 from hemagglutinin__InfluenzaA__AEG65109
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcaagcugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcaagcgccgguccaacaacagcuucuucucccgccugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcagagcuccgggcggaucaccgugagcaccaagcgcagccagcagacggugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggccugcccccgguacgucaagcagaacacccugaagcucgccaccggcaugcgcaacgugcccgagaagcagacccgggggaucuucggcgcgaucgccggguucaucgagaacggcugggagggcaugguggacgggugguacggcuuccgccaccagaacuccgaggggaucggccaggccgccgaccucaagagcacgcaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 67759 - RNA, 1701 nt, Artificial Sequence
  derived and/or modified sequence opt1 from hemagglutinin__InfluenzaA__AEG65120
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucgccuacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggaucggccaggccgcggaccugaaguccacgcaggccgccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 67760 - RNA, 1701 nt, Artificial Sequence
  derived and/or modified sequence opt1 from hemagglutinin__InfluenzaA__AEG65131
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcacagcaaguucaaguaccccgcccugaacgugaccaugcccaacaacgagaaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcgugguccugcugggcuucaucaugugggccugccagaaggggaacauccggugcaacaucugcaucuga

SEQ ID NO: 67761 - RNA, 1701 nt, Artificial Sequence; identical to SEQ ID NO: 61059
  derived and/or modified sequence opt1 from hemagglutinin__InfluenzaA__AEG65142

SEQ ID NO: 67762 - RNA, 1701 nt, Artificial Sequence; identical to SEQ ID NO: 61059
  derived and/or modified sequence opt1 from hemagglutinin__InfluenzaA__AEG65153

SEQ ID NO: 67763 - RNA, 1701 nt, Artificial Sequence
  derived and/or modified sequence opt1 from hemagglutinin__InfluenzaA__AEG65164
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgaguuccugguggcccuggagaaccagcacaccaucgaccucacggacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacguguaccgggacgaggcgcucaacaaccgcuuccagaucaagggggucgagcugaaguccggcuacaaggacuggauccuguggaucagcuucgccaucagcugcuuccuccugugcaucgugcugcucggcuucaucaugugggccugccagaaggggaacauccggugcaacaucugcaucuga

SEQ ID NO: 67764 - RNA, 1701 nt, Artificial Sequence
  derived and/or modified sequence opt1 from hemagglutinin__InfluenzaA__AEG65175
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcaacggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcgacaucugcaucuga

SEQ ID NO: 67765 - RNA, 1701 nt, Artificial Sequence; identical to SEQ ID NO: 61427
  derived and/or modified sequence opt1 from hemagglutinin__InfluenzaA__AEG65186

SEQ ID NO: 67766 - RNA, 1701 nt, Artificial Sequence
  derived and/or modified sequence opt1 from hemagglutinin__InfluenzaA__AEG65197
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcucccccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuacccguacgacgugcccgacuacgcgucccugcggagccucgucgccuccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccacccggggaccgacaacgaccagaucucccuguacgcgcaggccagcggccggaucaccguguccacgaagcgcagccagcagaccgugauccccaacaucggcagccggccccgcguccgggacauccccucccgcaucagcaucuacuggaccaucgugaagccgggggacaucauccugaucaacuccaccggcaaccucaucgcgccccggggguacuucaagauccgcagcggcaaguccagcaucaugcgguccgacacgcccaucggcaagugcaacagcgagugcaucacccccaacggguccaucccgaacgacaagcccuuccagaacgugaaccgcaucaccuacggcgccugcccccgguacgucaagcagaacacccugaagcuggccacggggaugcgcaacgugcccgagaagcagacccggggcaucuucggggccaucgccggcuucaucgagaacggcugggaggggaugguggacggcugguacggguuccgccaccagaacagcgagggcaucgggcaggccgccgaccucaaguccacccaggccgcgaucaaccagaucaacggcaagcugaaccggcugaucggcaagaccaacgagaaguuccaccagaucgagaaggaguucagcgaggucgaggggcgcauccaggaccucgagaaguacguggaggacacgaagaucgaccugugguccuacaacgccgagcugcucguggcccuggagaaccagcacaccaucgaccugaccgacagcgagaugaacaagcuguucgagcggaccaagaagcagcuccgcgagaacgccgaggacaugggcaacgggugcuucaagaucuaccacaagugcgacaacgccugcaucggcuccauccgcaacgggacguacgaccacgacgucuaccgggacgaggcgcugaacaaccgcuuccagaucaagggcguggagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 67767 - RNA, 1701 nt, Artificial Sequence; identical to SEQ ID NO: 61638
  derived and/or modified sequence opt1 from hemagglutinin__InfluenzaA__AEG65208

SEQ ID NO: 67768 - RNA, 1701 nt, Artificial Sequence
  derived and/or modified sequence opt1 from hemagglutinin__InfluenzaA__AEG65219
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacaucaagugcaacaucugcaucuga

SEQ ID NO: 67769 - RNA, 1701 nt, Artificial Sequence; identical to SEQ ID NO: 62803
  derived and/or modified sequence opt1 from hemagglutinin__InfluenzaA__AEG65230

SEQ ID NO: 67770 - RNA, 1701 nt, Artificial Sequence; identical to SEQ ID NO: 62803
  derived and/or modified sequence opt1 from hemagglutinin__InfluenzaA__AEG65252

SEQ ID NO: 67771 - RNA, 1701 nt, Artificial Sequence; identical to SEQ ID NO: 61524
  derived and/or modified sequence opt1 from hemagglutinin__InfluenzaA__AEG65263

SEQ ID NO: 67772 - RNA, 1701 nt, Artificial Sequence; identical to SEQ ID NO: 61524
  derived and/or modified sequence opt1 from hemagglutinin__InfluenzaA__AEG65274

SEQ ID NO: 67773 - RNA, 1701 nt, Artificial Sequence; identical to SEQ ID NO: 61524
  derived and/or modified sequence opt1 from hemagglutinin__InfluenzaA__AEG65285

SEQ ID NO: 67774 - RNA, 1701 nt, Artificial Sequence
  derived and/or modified sequence opt1 from hemagglutinin__InfluenzaA__AEG65296
augaagaccgugaucgcccugagcuacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgucccggaccacgcgagccugcggucccucguggccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgucaccaugcccaacaacgagaaguucgacaagcucuacaucuggggcgugcaccaccccgggaccgacagcgaccagaucucccuguacgcgcaggccagcggccggaucaccgugagcacgaagcgcucccagcagaccgucaucccgaacaucggcagccggccccgcgugcgggacguguccagccgcaucuccaucuacuggaccaucgucaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 67775 - RNA, 1701 nt, Artificial Sequence; identical to SEQ ID NO: 62803
  derived and/or modified sequence opt1 from hemagglutinin__InfluenzaA__AEG65307

SEQ ID NO: 67776 - RNA, 1701 nt, Artificial Sequence
  derived and/or modified sequence opt1 from hemagglutinin__InfluenzaA__AEG65318
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugcgccagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 67777 - RNA, 1701 nt, Artificial Sequence; identical to SEQ ID NO: 62803
  derived and/or modified sequence opt1 from hemagglutinin__InfluenzaA__AEG65329

SEQ ID NO: 67778 - RNA, 1701 nt, Artificial Sequence
  derived and/or modified sequence opt1 from hemagglutinin__InfluenzaA__AEG65340
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 67779 - RNA, 1701 nt, Artificial Sequence; identical to SEQ ID NO: 62803
  derived and/or modified sequence opt1 from hemagglutinin__InfluenzaA__AEG65351

SEQ ID NO: 67780 - RNA, 1701 nt, Artificial Sequence; identical to SEQ ID NO: 62803
  derived and/or modified sequence opt1 from hemagglutinin__InfluenzaA__AEG65362

SEQ ID NO: 67781 - RNA, 1701 nt, Artificial Sequence; identical to SEQ ID NO: 67778
  derived and/or modified sequence opt1 from hemagglutinin__InfluenzaA__AEG65373

SEQ ID NO: 67782 - RNA, 1701 nt, Artificial Sequence; identical to SEQ ID NO: 61524
  derived and/or modified sequence opt1 from hemagglutinin__InfluenzaA__AEG65384

SEQ ID NO: 67783 - RNA, 1701 nt, Artificial Sequence; identical to SEQ ID NO: 61524
  derived and/or modified sequence opt1 from hemagglutinin__InfluenzaA__AEG65406

SEQ ID NO: 67784 - RNA, 1701 nt, Artificial Sequence; identical to SEQ ID NO: 61524
  derived and/or modified sequence opt1 from hemagglutinin__InfluenzaA__AEG65417

SEQ ID NO: 67785 - RNA, 1701 nt, Artificial Sequence; identical to SEQ ID NO: 61524
  derived and/or modified sequence opt1 from hemagglutinin__InfluenzaA__AEG65428

SEQ ID NO: 67786 - RNA, 1701 nt, Artificial Sequence
  derived and/or modified sequence opt1 from hemagglutinin__InfluenzaA__AEG65439
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcgucgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 67787 - RNA, 1701 nt, Artificial Sequence
  derived and/or modified sequence opt1 from hemagglutinin__InfluenzaA__AEG65450
augaagaccaucaucgccuggagcuacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccugaucgccagcuccgggacgcucgaguucaacaacgagagcuucaacuggaccggcgucacccagaacgggaccuccagcgccugcaagcgccgguccaacagcuccuucuucagccgccugaacuggcugacgcaccucaaguucaaguaccccgcccugaacgugaccaugcccaacaacgaggaguucgacaagcuguacaucuggggcgugcaccaccccgggaccuacaacgaccagaucucccucuacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcuggcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccucaaguccacccaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 67788 - RNA, 1701 nt, Artificial Sequence; identical to SEQ ID NO: 67787
  derived and/or modified sequence opt1 from hemagglutinin__InfluenzaA__AEG65461

SEQ ID NO: 67789 - RNA, 1701 nt, Artificial Sequence
  derived and/or modified sequence opt1 from hemagglutinin__InfluenzaA__AEG65472
augaagaccaucaucgccuggagcuacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccugaucgccagcuccgggacgcucgaguucaacaacgagagcuucaacuggaccggcgucacccagaacgggaccuccagcgccugcaagcgccgguccaacagcuccuucuucagccgccugaacuggcugacgcaccucaaguucaaguaccccgcccugaacgugaccaugcccaacaacgaggaguucgacaagcuguacaucuggggcgugcaccaccccgggaccuacaacgaccagaucucccucuacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcugaucaacuccaccggcaaccucaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcuggcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccucaaguccacccaggcggccaucgaccagaucaacggcaagcugaaccggcugaucggcaagaccaacgagaaguuccaccagaucgagaaggaguucagcgagguggaggggcgcauccaggaccucgagaaguacgucgaggacaccaagaucgaccugugguccuacaacgccgagcugcucguggcccuggagaaccagcacacgaucgaccugaccgacagcgagaugaacaagcuguucgagaucaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagagcggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 67790 - RNA, 1701 nt, Artificial Sequence; identical to SEQ ID NO: 67787
  derived and/or modified sequence opt1 from hemagglutinin__InfluenzaA__AEG65483

SEQ ID NO: 67791 - RNA, 1701 nt, Artificial Sequence; identical to SEQ ID NO: 67787
  derived and/or modified sequence opt1 from hemagglutinin__InfluenzaA__AEG65494

SEQ ID NO: 67792 - RNA, 1701 nt, Artificial Sequence; identical to SEQ ID NO: 67787
  derived and/or modified sequence opt1 from hemagglutinin__InfluenzaA__AEG65505

SEQ ID NO: 67793 - RNA, 1701 nt, Artificial Sequence; identical to SEQ ID NO: 67787
  derived and/or modified sequence opt1 from hemagglutinin__InfluenzaA__AEG65516

SEQ ID NO: 67794 - RNA, 1701 nt, Artificial Sequence; identical to SEQ ID NO: 67787
  derived and/or modified sequence opt1 from hemagglutinin__InfluenzaA__AEG65527

SEQ ID NO: 67795 - RNA, 1701 nt, Artificial Sequence; identical to SEQ ID NO: 67787
  derived and/or modified sequence opt1 from hemagglutinin__InfluenzaA__AEG65538

SEQ ID NO: 67796 - RNA, 1701 nt, Artificial Sequence
  derived and/or modified sequence opt1 from hemagglutinin__InfluenzaA__AEG65560
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugaaguccgacgcccccaucggcaagugcaacagcgagugcaucacgcccaacggguccauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacacgaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 67797 - RNA, 1701 nt, Artificial Sequence; identical to SEQ ID NO: 67796
  derived and/or modified sequence opt1 from hemagglutinin__InfluenzaA__AEG65571

SEQ ID NO: 67798 - RNA, 1701 nt, Artificial Sequence; identical to SEQ ID NO: 67796
  derived and/or modified sequence opt1 from hemagglutinin__InfluenzaA__AEG65582

SEQ ID NO: 67799 - RNA, 1701 nt, Artificial Sequence; identical to SEQ ID NO: 67796
  derived and/or modified sequence opt1 from hemagglutinin__InfluenzaA__AEG65593

SEQ ID NO: 67800 - RNA, 1701 nt, Artificial Sequence
  derived and/or modified sequence opt1 from hemagglutinin__InfluenzaA__AEG65604
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccuccggcaagaucaccgucagcacgaagcggagccagcagaccgugaucccgaacaucggcucccgcccccgggugcgcgacauccccagccggaucuccaucuacuggaccaucgucaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 67801 - RNA, 1701 nt, Artificial Sequence
  derived and/or modified sequence opt1 from hemagglutinin__InfluenzaA__AEG65626
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaacagcuucuucucccggcugaacuggcucacgcaccugaaguucaaguaccccgcccugaacgugaccaugcccaacaacaagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacauccccagccggaucuccaucuacuggaccaucgugaagcccggggacaugcugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacacgaagaucgaccuguggagcuacaacgccgagcuccugguggcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 67802 - RNA, 1701 nt, Artificial Sequence
  derived and/or modified sequence opt1 from hemagglutinin__InfluenzaA__AEG65637
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaacagcuucuucucccggcugaacuggcucacgcaccugaaguucaaguaccccgcccugaacgugaccaugcccaacaacaagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacauccccagccggaucuccaucuacuggaccaucgugaagcccggggacaugcugcucaucaacagcaccggcaaccugaucgccccgcgcggguacuucaagauccgguccggccgcagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 67803 - RNA, 1701 nt, Artificial Sequence; identical to SEQ ID NO: 61039
  derived and/or modified sequence opt1 from hemagglutinin__InfluenzaA__AEG65648

SEQ ID NO: 67804 - RNA, 1701 nt, Artificial Sequence; identical to SEQ ID NO: 62803
  derived and/or modified sequence opt1 from hemagglutinin__InfluenzaA__AEG65659

SEQ ID NO: 67805 - RNA, 1701 nt, Artificial Sequence; identical to SEQ ID NO: 62803
  derived and/or modified sequence opt1 from hemagglutinin__InfluenzaA__AEG65670

SEQ ID NO: 67806 - RNA, 1701 nt, Artificial Sequence; identical to SEQ ID NO: 62803
  derived and/or modified sequence opt1 from hemagglutinin__InfluenzaA__AEG65681

SEQ ID NO: 67807 - RNA, 1701 nt, Artificial Sequence; identical to SEQ ID NO: 67778
  derived and/or modified sequence opt1 from hemagglutinin__InfluenzaA__AEG65692

SEQ ID NO: 67808 - RNA, 1701 nt, Artificial Sequence; identical to SEQ ID NO: 61638
  derived and/or modified sequence opt1 from hemagglutinin__InfluenzaA__AEG65703

SEQ ID NO: 67809 - RNA, 1701 nt, Artificial Sequence
  derived and/or modified sequence opt1 from hemagglutinin__InfluenzaA__AEG65747
augaagaccaucaucgcccugagcuacauccucugccugguguucgcccagaagcugcccggcaacgacaacuccaccgcgacgcucugccuggggcaccacaccgucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacagcgaggggaccggccaggccgccgaccugaaguccacccaggccgcgaucaaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacauggggaacggcugcuucaagaucuaccacaagugcgacaacgccugcaucggguccauccgcaacggcaccuacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67810 - RNA, 1701 nt, Artificial Sequence
  derived and/or modified sequence opt1 from hemagglutinin__InfluenzaA__AEG65758
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcagccagcagaccgugaucccgaacaucggcucccggccccgcguccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 67811 - RNA, 1701 nt, Artificial Sequence; identical to SEQ ID NO: 61289
  derived and/or modified sequence opt1 from hemagglutinin__InfluenzaA__AEG65769

SEQ ID NO: 67812 - RNA, 1701 nt, Artificial Sequence
  derived and/or modified sequence opt1 from hemagglutinin__InfluenzaA__AEG65780
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgacaagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccgccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccgccgggcggaucaccguguccacgaagcgcagccagcaggccgugaucccgaacaucggcucccggccccgcguccggaacauccccagccgcgugagcaucuacuggaccaucgugaagcccggcgacauccugcucaucaacuccaccgggaaccugaucgcgccgcggggcuacuucaagauccgcagcgggaaguccagcaucaugcgguccgacgcccccaucggcaagugcaacagcgccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgcgaucgccggguucaucgagaacggcugggagggcauggucgacgggugguacggcuuccgccaccagaacagcgaggggcggggccaggccgccgaccugaaguccacgcaggccgcgaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcgcucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 67813 - RNA, 1701 nt, Artificial Sequence
  derived and/or modified sequence opt1 from hemagglutinin__InfluenzaA__AEG65813
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaccgaccuguggagcuacaacgcggagcuccuggucgcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 67814 - RNA, 1701 nt, Artificial Sequence
  derived and/or modified sequence opt1 from hemagglutinin__InfluenzaA__AEG79801
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccgcgagggccggaugaacuacuacuggacccugguggagcccggggacaagaucaccuucgaggcgacgggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcgccucgcgacgggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 67815 - RNA, 1701 nt, Artificial Sequence
  derived and/or modified sequence opt1 from hemagglutinin__InfluenzaA__AEG79807
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccacggccgaccagcaguccaucuaccagaacgccgacgccuacguguucguggggaccagccgguacuccaagaaguucaagcccgagaucgccauccgcccgaagguccgggaccaggagggccgcaugaacuacuacuggacccugguggagcccggcgacaagaucaccuucgaggcgacggggaaccugguggucccccgguacgccuucgccauggagcgcaacgccggcagcgggaucaucaucuccgacacccccgugcacgacugcaacacgaccugccagaccccgaagggcgccaucaacaccagccuccccuuccagaacauccaccccaucaccaucggcaagugccccaaguacgugaaguccaccaagcugcggcuggcgacggggcuccgcaacgucccgagcauccagucccggggccuguucggggccaucgccggcuucaucgagggcggguggaccggcaugguggacgggugguacggcuaccaccaccagaacgagcaggggagcggcuacgccgccgaccugaaguccacccagaacgcgaucgacaagaucaccaacaaggugaacagcgucaucgagaagaugaacacgcaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgcgaucuacuccaccgucgccagcucccuggugcugguggucagccucggcgccaucagcuucuggaugugcuccaacgggagccugcagugccggaucugcaucuga

SEQ ID NO: 67816 - RNA, 1701 nt, Artificial Sequence
  derived and/or modified sequence opt1 from hemagglutinin__InfluenzaA__AEG79835
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagcaucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 67817 - RNA, 1701 nt, Artificial Sequence
  derived and/or modified sequence opt1 from hemagglutinin__InfluenzaA__AEH59363
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagagcacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgcgaggagaucgacggcgugaagcuggagagcacccggaucuaccagauccuggccaucuacuccaccgucgccagcagccucgugcugguggucucccugggggccaucagcuucuggaugugcuccaacggcagccuccagugccgcaucugcaucuga

SEQ ID NO: 67818 - RNA, 1701 nt, Artificial Sequence
  derived and/or modified sequence opt1 from hemagglutinin__InfluenzaA__AEH59367
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacugggcgcugguggagcccggggacaagaucaccuucgaggccaccggcaaccucguggucccccgguacgccuucgccauggagcgcaacgccgggagcggcaucaucaucuccgacacgcccgugcacgacugcaacacgaccugccagaccccgaagggcgcgaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgccggguucaucgagggcggcuggacggggaugguggacggcugguacggguaccaccaccagaacgagcagggcagcggguacgccgcggaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcucccuggugcucguggucagccugggggccaucagcuucuggaugugcuccaacggcagccugcagugccggaucugcaucuga

SEQ ID NO: 67819 - RNA, 1701 nt, Artificial Sequence
  derived and/or modified sequence opt1 from hemagglutinin__InfluenzaA__AEH59369
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaaggccagcuccuggcccaaccacgacagcaacaagggggucaccgccgccugcccgcacgcgggcgccaagggguucuacaagaaccugaucuggcucgugaagaagggcaacuccuaccccaagcugagcaaguccuacaucaacgacaaggggaaggaggugcugguccucuggggcauccaccaccccagcaccaccgccgaccagcagagccuguaccagaacgccgacacguacguguucgugggcaccucccgguacagcaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagagcaccaagcugcggcucgcgacggggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucucccugggcgccaucagcuucuggaugugcagcaacggcucccugcagugccggaucugcaucuga

SEQ ID NO: 67820 - RNA, 1701 nt, Artificial Sequence; identical to SEQ ID NO: 67817
  derived and/or modified sequence opt1 from hemagglutinin__InfluenzaA__AEH59371

SEQ ID NO: 67821 - RNA, 1701 nt, Artificial Sequence
  derived and/or modified sequence opt1 from hemagglutinin__InfluenzaA__AEH59373
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcgaggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaagggcuucuacaagaaccugaucuggcucgugaagaaggggaacuccuaccccaagcugagcaaguccuacaucaacgacaagggcaaggaggugcugguccucugggggauccaccaccccagcaccacggccgaccagcagagccuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccgccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagcggcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 67822 - RNA, 1701 nt, Artificial Sequence; identical to SEQ ID NO: 67817
  derived and/or modified sequence opt1 from hemagglutinin__InfluenzaA__AEH59375

SEQ ID NO: 67823 - RNA, 1701 nt, Artificial Sequence
  derived and/or modified sequence opt1 from hemagglutinin__InfluenzaA__AEH59379
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 67824 - RNA, 1701 nt, Artificial Sequence; identical to SEQ ID NO: 67817
  derived and/or modified sequence opt1 from hemagglutinin__InfluenzaA__AEH59381

SEQ ID NO: 67825 - RNA, 1701 nt, Artificial Sequence
  derived and/or modified sequence opt1 from hemagglutinin__InfluenzaA__AEH59383
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaucuccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 67826 - RNA, 1701 nt, Artificial Sequence
  derived and/or modified sequence opt1 from hemagglutinin__InfluenzaA__AEH59385
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacaucuucgugggcaccagccgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 67827 - RNA, 1701 nt, Artificial Sequence; identical to SEQ ID NO: 67817
  derived and/or modified sequence opt1 from hemagglutinin__InfluenzaA__AEH59387

SEQ ID NO: 67828 - RNA, 1701 nt, Artificial Sequence
  derived and/or modified sequence opt1 from hemagglutinin__InfluenzaA__AEH59393
augaaggccauccugguggucauccucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 67829 - RNA, 1701 nt, Artificial Sequence
  derived and/or modified sequence opt1 from hemagglutinin__InfluenzaA__AEH59397
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccagccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgagaacgggugcuucgaguucuaccacaagugcgacaacacgugcauggaguccgugaagaacggcaccuacgacuaccccaaguacagcgaggaggccaagcucaaccgcgaggagaucgacggggugaagcuggaguccacccggaucuaccagauccuggcgaucuacagcaccgucgccagcucccucgugcugguggucagccugggcgccaucuccuucuggaugugcagcaacgggucccuccagugccgcaucugcaucuga

SEQ ID NO: 67830 - RNA, 1701 nt, Artificial Sequence
  derived and/or modified sequence opt1 from hemagglutinin__InfluenzaA__AEH59399
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggaccaucguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 67831 - RNA, 1701 nt, Artificial Sequence
  derived and/or modified sequence opt1 from hemagglutinin__InfluenzaA__AEH59403
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggcccccggcgacaagaucacguucgaggcgaccgggaaccucguggucccccgguacgccuucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgcgaccgggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacccagaacgcgaucgacaagaucacgaacaaggugaacuccgucaucgagaagaugaacacccaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucucccugggcgccaucagcuucuggaugugcagcaacggcucccugcagugccggaucugcaucuga

SEQ ID NO: 67832 - RNA, 1701 nt, Artificial Sequence
  derived and/or modified sequence opt1 from hemagglutinin__InfluenzaA__AEH59407
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 67833 - RNA, 1701 nt, Artificial Sequence; identical to SEQ ID NO: 67832
  derived and/or modified sequence opt1 from hemagglutinin__InfluenzaA__AEH59409

SEQ ID NO: 67834 - RNA, 1701 nt, Artificial Sequence
  derived and/or modified sequence opt1 from hemagglutinin__InfluenzaA__AEH59411
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggaccgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 67835 - RNA, 1701 nt, Artificial Sequence
  derived and/or modified sequence opt1 from hemagglutinin__InfluenzaA__AEH59413
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccuccaaguacagcaagaaguucaagcccgagaucgccguccggccgaaggugcgcgaccaggagggccggaugaacuacuacuggacgcugguggagcccggggacaagaucaccuucgaggcgaccggcaaccuccuggucccccgcuacgccuucgccauggagcggaacgccggguccggcaucaucaucagcgacacccccgugcacgacugcaacacgaccugccagaccccggagggcgccaucaacaccucccugcccuuccagaacauccaccccaucacgaucgggaagugccccaaguacgucaagagcaccaagcuccgccuggcgaccggccugcggaacgugccguccauccagagccgcggccucuucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccugaacaagaaggucgacgacggcuuccuggacaucuggacguacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 67836 - RNA, 1701 nt, Artificial Sequence
  derived and/or modified sequence opt1 from hemagglutinin__InfluenzaA__AEH59585
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacgguggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcguccagccuggugcucgucgugagccugggggccaucuccuucuggaugugcagcaacggcucccugcagugccggaucugcaucuga

SEQ ID NO: 67837 - RNA, 1701 nt, Artificial Sequence
  derived and/or modified sequence opt1 from hemagglutinin__InfluenzaA__AEH59587
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguucauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacgguggucggcaaggaguucaacccccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcguccagccuggugcucgucgugagccugggggccaucuccuucuggaugugcagcaacggcucccugcagugccggaucugcaucuga

SEQ ID NO: 67838 - RNA, 1701 nt, Artificial Sequence; identical to SEQ ID NO: 64841
  derived and/or modified sequence opt1 from hemagglutinin__InfluenzaA__AEH59589

SEQ ID NO: 67839 - RNA, 1701 nt, Artificial Sequence
  derived and/or modified sequence opt1 from hemagglutinin__InfluenzaA__AEH59591
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacgguggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 67840 - RNA, 1701 nt, Artificial Sequence
  derived and/or modified sequence opt1 from hemagglutinin__InfluenzaA__AEH59593
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagcaucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 67841 - RNA, 1701 nt, Artificial Sequence; identical to SEQ ID NO: 64475
  derived and/or modified sequence opt1 from hemagglutinin__InfluenzaA__AEH59595

SEQ ID NO: 67842 - RNA, 1701 nt, Artificial Sequence; identical to SEQ ID NO: 64841
  derived and/or modified sequence opt1 from hemagglutinin__InfluenzaA__AEH59597

SEQ ID NO: 67843 - RNA, 1701 nt, Artificial Sequence; identical to SEQ ID NO: 67836
  derived and/or modified sequence opt1 from hemagglutinin__InfluenzaA__AEH59599

SEQ ID NO: 67844 - RNA, 1701 nt, Artificial Sequence
  derived and/or modified sequence opt1 from hemagglutinin__InfluenzaA__AEH59601
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacgguggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 67845 - RNA, 1701 nt, Artificial Sequence; identical to SEQ ID NO: 64475
  derived and/or modified sequence opt1 from hemagglutinin__InfluenzaA__AEH59604

SEQ ID NO: 67846 - RNA, 1701 nt, Artificial Sequence; identical to SEQ ID NO: 64475
  derived and/or modified sequence opt1 from hemagglutinin__InfluenzaA__AEH59614

SEQ ID NO: 67847 - RNA, 1701 nt, Artificial Sequence
  derived and/or modified sequence opt1 from hemagglutinin__InfluenzaA__AEH59624
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcaguccuucuaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccugguggucccccgguacgccuucgccauggagcgcaacgccgggagcggcaucaucaucuccgacacgccggugcacgacugcaacacgaccugccagacccccaagggcgccaucaacaccagccuccccuuccagaacauccaccccaucaccaucgggaagugcccgaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccuccagccuggugcugguggucagccucggggccaucuccuucuggaugugcagcaacggcucccugcagugccggaucugcaucuga

SEQ ID NO: 67848 - RNA, 1698 nt, Artificial Sequence
  derived and/or modified sequence opt1 from hemagglutinin__InfluenzaA__AEH77259
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagauguucccgaaggaguccagcuggcccaaccacacggucaccgggguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagaucgccaagcgccccaaggugcgggaccaggaggggcgcaucaacuacuacuggacccuccuggagcccggcgacaccaucaucuucgaggccaacggcaaccugaucgcgccgcgguacgccuucgcccucucccgcggguucggcagcgggaucaucaacuccaacgcccccauggacaagugcgacgccaagugccagacgccccagggcgcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggcuggaccggcaugguggacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggggucuaccagauccuggcgaucuacagcaccguggccuccagccugguguuccucgucucccugggcgccaucagcuucuggaugugcuccaacggcagccugcagugccggaucugcaucuga

SEQ ID NO: 67849 - RNA, 1701 nt, Artificial Sequence; identical to SEQ ID NO: 63664
  derived and/or modified sequence opt1 from hemagglutinin__InfluenzaA__AEH77270

SEQ ID NO: 67850 - RNA, 1701 nt, Artificial Sequence; identical to SEQ ID NO: 61040
  derived and/or modified sequence opt1 from hemagglutinin__InfluenzaA__AEH77279

SEQ ID NO: 67851 - RNA, 1701 nt, Artificial Sequence; identical to SEQ ID NO: 64779
  derived and/or modified sequence opt1 from hemagglutinin__InfluenzaA__AEI29215

SEQ ID NO: 67852 - RNA, 1701 nt, Artificial Sequence; identical to SEQ ID NO: 63677
  derived and/or modified sequence opt1 from hemagglutinin__InfluenzaA__AEI29225

SEQ ID NO: 67853 - RNA, 1701 nt, Artificial Sequence
  derived and/or modified sequence opt1 from hemagglutinin__InfluenzaA__AEI29591
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccaaccuguacgugcaggccagcgggaaggucaccguguccacgaagcggagccagcagaccgugauccccaacgucgggagccgccccugggugcggggccucuccagccgcguguccaucuacuggaccaucgucaagcccggcgacauccuggugaucaacagcaacgggaaccugaucgcgccgcggggcuacuacaagaugcgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcagcauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 67854 - RNA, 1701 nt, Artificial Sequence; identical to SEQ ID NO: 61040
  derived and/or modified sequence opt1 from hemagglutinin__InfluenzaA__AEI54347

SEQ ID NO: 67855 - RNA, 1701 nt, Artificial Sequence; identical to SEQ ID NO: 61126
  derived and/or modified sequence opt1 from hemagglutinin__InfluenzaA__AEI54358

SEQ ID NO: 67856 - RNA, 1701 nt, Artificial Sequence; identical to SEQ ID NO: 61641
  derived and/or modified sequence opt1 from hemagglutinin__InfluenzaA__AEI54369

SEQ ID NO: 67857 - RNA, 1701 nt, Artificial Sequence; identical to SEQ ID NO: 61524
  derived and/or modified sequence opt1 from hemagglutinin__InfluenzaA__AEI54380

SEQ ID NO: 67858 - RNA, 1701 nt, Artificial Sequence; identical to SEQ ID NO: 67787
  derived and/or modified sequence opt1 from hemagglutinin__InfluenzaA__AEI54391

SEQ ID NO: 67859 - RNA, 1701 nt, Artificial Sequence
  derived and/or modified sequence opt1 from hemagglutinin__InfluenzaA__AEI54402
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcuacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 67860 - RNA, 1701 nt, Artificial Sequence; identical to SEQ ID NO: 62936
  derived and/or modified sequence opt1 from hemagglutinin__InfluenzaA__AEI54413

SEQ ID NO: 67861 - RNA, 1701 nt, Artificial Sequence; identical to SEQ ID NO: 61289
  derived and/or modified sequence opt1 from hemagglutinin__InfluenzaA__AEI54424

SEQ ID NO: 67862 - RNA, 1701 nt, Artificial Sequence
  derived and/or modified sequence opt1 from hemagglutinin__InfluenzaA__AEI54446
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcaacagcccccaccagauccucgacggggagaacugcacccugaucgacgcccugcucggcgacccccagugcgacggguuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccggccggaucaccgugagcacgaagcgcucccagcaggccgugaucccgaacaucgggagccggccccgcguccggaacauccccagccgcguguccaucuacuggaccaucgugaagcccggcgacauccugcucaucaacagcaccggcaaccugaucgccccgcggggguacuucaagauccgcuccggcaagagcuccaucaugcggagcgacgcgcccaucgggaagugcaacuccgccugcaucacccccaacggcagcauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgcgggcuucaucgagaacgggugggagggcauggucgacggcugguacggguuccgccaccagaacuccgagggccgggggcaggccgccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgcccugcucggcuucaucaugugggccugccagaagggcaacauccggugcaacaucugcaucuga

SEQ ID NO: 67863 - RNA, 1701 nt, Artificial Sequence
  derived and/or modified sequence opt1 from hemagglutinin__InfluenzaA__AEI54457
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 67864 - RNA, 1701 nt, Artificial Sequence; identical to SEQ ID NO: 66541
  derived and/or modified sequence opt1 from hemagglutinin__InfluenzaA__AEI54468

SEQ ID NO: 67865 - RNA, 1701 nt, Artificial Sequence; identical to SEQ ID NO: 66541
  derived and/or modified sequence opt1 from hemagglutinin__InfluenzaA__AEI54479

SEQ ID NO: 67866 - RNA, 1701 nt, Artificial Sequence; identical to SEQ ID NO: 67863
  derived and/or modified sequence opt1 from hemagglutinin__InfluenzaA__AEI54490

SEQ ID NO: 67867 - RNA, 1701 nt, Artificial Sequence; identical to SEQ ID NO: 67862
  derived and/or modified sequence opt1 from hemagglutinin__InfluenzaA__AEI54501

SEQ ID NO: 67868 - RNA, 1701 nt, Artificial Sequence
  derived and/or modified sequence opt1 from hemagglutinin__InfluenzaA__AEI59979
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucgagaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaagggcaacauccggugcaacaucugcaucuga

SEQ ID NO: 67869 - RNA, 1698 nt, Artificial Sequence; identical to SEQ ID NO: 66965
  derived and/or modified sequence opt1 from hemagglutinin__InfluenzaA__AEI59990

SEQ ID NO: 67870 - RNA, 1698 nt, Artificial Sequence; identical to SEQ ID NO: 66967
  derived and/or modified sequence opt1 from hemagglutinin__InfluenzaA__AEI60001

SEQ ID NO: 67871 - RNA, 1701 nt, Artificial Sequence
  derived and/or modified sequence opt1 from hemagglutinin__InfluenzaA__AEI60012
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcuccagcaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcgcaucaccgugagcacgaagcggagccagcagaccgugaucccgaacaucggcucccgcccccggguccgcaacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgaggucgagggcaagauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacaaccacgacgucuaccgcgacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 67872 - RNA, 1701 nt, Artificial Sequence; identical to SEQ ID NO: 63442
  derived and/or modified sequence opt1 from hemagglutinin__InfluenzaA__AEI60023

SEQ ID NO: 67873 - RNA, 1701 nt, Artificial Sequence
  derived and/or modified sequence opt1 from hemagglutinin__InfluenzaA__AEI60034
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67874 - RNA, 1701 nt, Artificial Sequence
  derived and/or modified sequence opt1 from hemagglutinin__InfluenzaA__AEI60045
augaagaccaucaucgcccugagcuacauccucugccugguguucgcccagaagcugcccggcaacgacaacuccaccgcgacgcucugccuggggcaccacgccgucccgaacggcaccaucgugaagaccaucaugaacgaccagaucgaggugaccaacgccacggagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaagaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccagcgggcggaucaccguguccaccaagcgcagccagcagacggccaucccgaacaucggcuaccggccccgcgugcggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 67875 - RNA, 1701 nt, Artificial Sequence
  derived and/or modified sequence opt1 from hemagglutinin__InfluenzaA__AEI60086
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 67876 - RNA, 1701 nt, Artificial Sequence
  derived and/or modified sequence opt1 from hemagglutinin__InfluenzaA__AEI60109
augaagaccaccaucgcccugagcuacauccucugccugguguucgcccagaagcugcccggcaacgacaacuccacggcgacccucugccuggggcaccacgccgucccgaacggcacccuggugaagaccaucacgaacgaccagaucgaggugaccaacgccaccgagcucguccagaacagcuccaccgggcgcaucugcgacagcccccaccagauccuggacggcgagaacugcacgcugaucgacgcccuccugggggacccccacugcgacggcuuccagaacaaggagugggaccuguucguggagcgguccaaggccuacagcaacugcuaccccuacaacgugccggacuacgucucccuccgcagccugguggcguccagcggcacccuggaguucaacaacgaguccuucaacuggaccgggguggcccaggacggcagcuccuacgccugcaagcggcgcagcaacaaguccuucuucagccggcucaacuggcugcaccagcugaacuacaaguaccccgcccucaacgucaccaugcccaacaacgagaacuucgacaagcuguacaucuggggcgugcaccaccccgggacggacuccgaccagaucagccuguacgcgcaggccuccgggcgcgugaccgucagcaccaagcggagccagcagaccgugaucccgaacaucggcuaccgccccugggugcggggcgucuccagcaucaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugaaggacggcugguacggguuccggcaccagaacuccgagggcaccgggcaggccgccgacaucaagagcacgcaggccgcgaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagcgcaccaagaagcagcugcgggagaacgccgaggacauggggaacggcugcuucaagaucuaccacaagugcgacaacacgugcaucgggagcauccgcaacggcaccuacgaccacgacguguaccgcgacgaggcccucaacaaccgguuccacaucaagggggucgagcugaaguccggcuacaaggacuggauccuguggaucagcuucgcgaccuccugcuuccuccugugcaucgugcugcucggcuucaucaugugggccugccagaaggggaacauccgcugcaacaucugcaucuga

SEQ ID NO: 67877 - RNA, 1701 nt, Artificial Sequence
  derived and/or modified sequence opt1 from hemagglutinin__InfluenzaA__AEI86734
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcgucuccagcuucgagcgcuucgagaucuuccccaagaccuccagcuggcccaaccacgacuccaacaagggggugaccgccgccugcccgcacgccggcgccaagagcuucuaccggaaccugaucuggcucgugaagaaggggaacuccuaccccaagcugagcaaguccuacaucaacgacaagggcaaggagguccuggugcucugggggauccaccaccccagcaccagcgccgaccagcagucccuguaccagaacgccgacacguacguguucgucggcaccagccgcuacuccaagaaguucaagcccgagaucgccauccggccgaaggugcgcgaccaggagggccggaugaacuacuacuggacccugguggagcccggggacaagaucaccuucgaggccacgggcaaccucgucgugccccgcuacgcguucgccauggagcggaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgucaaguccaccaagcugcgccucgccacgggccugcggaacgugccgagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggucaacagcgugaucgagaagaugaacacgcaguucaccgcggucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacuccaacgucaagaaccucuacgagaaggugcggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgucaagcucgaguccacccggaucuaccagauccuggccaucuacagcaccguggcguccagccuggugcucgucgugagccugggggccaucuccuucuggaugugcagcaacggcucccugcagugccgcaucugcaucuga

SEQ ID NO: 67878 - RNA, 1701 nt, Artificial Sequence
  derived and/or modified sequence opt1 from hemagglutinin__InfluenzaA__AEI86764
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67879 - RNA, 1701 nt, Artificial Sequence; identical to SEQ ID NO: 67878
  derived and/or modified sequence opt1 from hemagglutinin__InfluenzaA__AEI86774

SEQ ID NO: 67880 - RNA, 1701 nt, Artificial Sequence
  derived and/or modified sequence opt1 from hemagglutinin__InfluenzaA__AEI86784
augaaggugauccuggucgugcuccuguacaccuucgccaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucaagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 67881 - RNA, 1701 nt, Artificial Sequence
  derived and/or modified sequence opt1 from hemagglutinin__InfluenzaA__AEI86794
augaagaccauccuggugguccuccuguacaccuucgccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcaacuucaucgacuacgaggagcuccgggagcagcugagcuccgugagcuccuucgagcgcuucgagaucuuccccaagaccagcuccuggcccgaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccuccaaguacagcaagaaguucaagcccgagaucgccauccggccgaagguccgcgaccaggagggccggaugaacuacuacuggacccugguggagcccggggacaagaucaccuucgaggccacgggcaaccucguggcgccccgcuacgccuucgccauggagcggaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 67882 - RNA, 1701 nt, Artificial Sequence
  derived and/or modified sequence opt1 from hemagglutinin__InfluenzaA__AEI86804
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugauguggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccgccgucgccagcagccuggugcucguggucucccugggggccaucagcuucuggaugugcuccaacggcagccugcagugccggaucugcaucuga

SEQ ID NO: 67883 - RNA, 1701 nt, Artificial Sequence; identical to SEQ ID NO: 67878
  derived and/or modified sequence opt1 from hemagglutinin__InfluenzaA__AEI86814

SEQ ID NO: 67884 - RNA, 1701 nt, Artificial Sequence
  derived and/or modified sequence opt1 from hemagglutinin__InfluenzaA__AEI86824
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaggacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67885 - RNA, 1701 nt, Artificial Sequence
  derived and/or modified sequence opt1 from hemagglutinin__InfluenzaA__AEI86834
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagccgcaaguucaagcccgagaucgccauccggccgaagguccgcgaccaggagggccggaugaacuacuacuggacccugguggagcccggggacaagaucaccuucgaggcgaccggcaaccucguggcgccccgcuacgccuucgccauggagcggaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcgccucgccaccggccugcggaacgugccguccauccagagccgcgggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgcgaggagaucgacggcgugaagcucgagagcacccggaucuaccagauccuggccaucuacuccaccguggccagcagccugguccucguggugucccugggggccaucagcuucuggaugugcuccaacggcagccugcagugccgcaucugcaucuga

SEQ ID NO: 67886 - RNA, 1701 nt, Artificial Sequence; identical to SEQ ID NO: 66592
  derived and/or modified sequence opt1 from hemagglutinin__InfluenzaA__AEI86854

SEQ ID NO: 67887 - RNA, 1701 nt, Artificial Sequence
  derived and/or modified sequence opt1 from hemagglutinin__InfluenzaA__AEI86864
augaaggccauccugguggcccuccuguacaccuucgcgaccgccaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccacggccgaccagcagucccuguaccagaacgccgacgccuacgucuucgugggcaccagccgguacuccaagaaguucaagcccgagaucgcgauccgcccgaaggugcgggaccaggagggccgcaugaacuacuacuggacccuggucgagcccggggacaagaucaccuucgaggccacgggcaaccucguggugccccgguacgccuucgccauggagcgcaacgccgggagcggcaucaucaucuccgacacccccguccacgacugcaacacgaccugccagaccccgaagggcgcgaucaacaccagccugcccuuccagaacauccaccccaucaccaucgggaagugccccaaguacgugaaguccaccaagcugcggcucgccacgggccugcgcaacgugccgagcauccagucccgggggcuguucggcgccaucgccggguucaucgagggcggcuggaccgggauggucgacggcugguacggguaccaccaccagaacgagcagggcagcggguacgccgcggaccucaaguccacccagaacgccaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcucccugguccucguggugagccugggggccaucagcuucuggaugugcuccaacggcagccugcagugccggaucugcaucuga

SEQ ID NO: 67888 - RNA, 1701 nt, Artificial Sequence; identical to SEQ ID NO: 67878
  derived and/or modified sequence opt1 from hemagglutinin__InfluenzaA__AEI86874

SEQ ID NO: 67889 - RNA, 1701 nt, Artificial Sequence
  derived and/or modified sequence opt1 from hemagglutinin__InfluenzaA__AEI86894
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 67890 - RNA, 1701 nt, Artificial Sequence
  derived and/or modified sequence opt1 from hemagglutinin__InfluenzaA__AEI86904
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 67891 - RNA, 1701 nt, Artificial Sequence
  derived and/or modified sequence opt1 from hemagglutinin__InfluenzaA__AEI86914
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuacccccggcuguccaagagcuacaucaacgacaagggcaaggaggugcugguccucugggggauccaccaccccagcaccacggccgaccagcagucccuguaccagaacgccgacgccuacguguucgugggcaccagccgcuacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcgccucgcgacgggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 67892 - RNA, 1701 nt, Artificial Sequence
  derived and/or modified sequence opt1 from hemagglutinin__InfluenzaA__AEI86924
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcguguucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucaucaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccguccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcucccuggugcucgucgugagccugggggccaucagcuucuggaugugcuccaacggcagccugcagugccggaucugcaucuga

SEQ ID NO: 67893 - RNA, 1701 nt, Artificial Sequence; identical to SEQ ID NO: 67878
  derived and/or modified sequence opt1 from hemagglutinin__InfluenzaA__AEI86934

SEQ ID NO: 67894 - RNA, 1701 nt, Artificial Sequence; identical to SEQ ID NO: 66592
  derived and/or modified sequence opt1 from hemagglutinin__InfluenzaA__AEI86944

SEQ ID NO: 67895 - RNA, 1701 nt, Artificial Sequence
  derived and/or modified sequence opt1 from hemagglutinin__InfluenzaA__AEI86964
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcguguucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccgugcgcccgaaggugcgggaccaggagggccgcaugaacuacuacuggacccuggucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacaugugcauggagagcgucaagaacgggacguacgacuaccccaaguacuccgaggaggccaagcugaaccgggaggagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 67896 - RNA, 1701 nt, Artificial Sequence; identical to SEQ ID NO: 66834
  derived and/or modified sequence opt1 from hemagglutinin__InfluenzaA__AEI86974

SEQ ID NO: 67897 - RNA, 1701 nt, Artificial Sequence; identical to SEQ ID NO: 66592
  derived and/or modified sequence opt1 from hemagglutinin__InfluenzaA__AEI86984

SEQ ID NO: 67898 - RNA, 1701 nt, Artificial Sequence; identical to SEQ ID NO: 66592
  derived and/or modified sequence opt1 from hemagglutinin__InfluenzaA__AEI86994

SEQ ID NO: 67899 - RNA, 1701 nt, Artificial Sequence
  derived and/or modified sequence opt1 from hemagglutinin__InfluenzaA__AEI87004
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgcgagcagcugagcuccgugagcuccuucgagcgguucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagggccuguaccagaacgccgacgccuacguguucgugggcacgagccgcuacuccaagaaguucaagcccgagaucgccauccggccgaagguccgcgaccaggaggggcggaugaacuacuacuggacccugguggagcccggcgacaagaucaccuucgaggcgaccgggaaccucguggcgccccgcuacgccuucgccauggagcggaacgccggcagcggcaucaucaucuccgacacgcccguccacgacugcaacacgaccugccagaccccgaagggggccaucaacaccagccugcccuuccagaacauccaccccaucaccaucggcaagugccccaaguacgugaaguccaccaagcugcgccucgccaccgggcugcggaacgugccgagcauccagucccgcggccuguucggggccaucgccggcuucaucgagggcggguggacgggcauggucgacgggugguacggcuaccaccaccagaacgagcaggggagcggcuacgccgcggaccucaaguccacccagaacgccaucgacaagaucaccaacaaggugaacagcgugaucgagaagaugaacacccaguucacggccgucggcaaggaguucaaccaccuggagaagcggaucgagaaccugaacaagaagguggacgacggguuccucgacaucuggaccuacaacgccgagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacaacacgugcauggaguccgucaagaacggcaccuacgacuaccccaaguacagcgaggaggcgaagcugaaccgcgaggagaucgacggggugaagcucgaguccacccggaucuaccagauccuggccaucuacagcaccguggccuccagccugguccucguggugagccugggcgccaucuccuucuggaugugcagcaacggcucccugcagugccgcaucugcaucuga

SEQ ID NO: 67900 - RNA, 1701 nt, Artificial Sequence
  derived and/or modified sequence opt1 from hemagglutinin__InfluenzaA__AEI87014
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccggcgaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 67901 - RNA, 1701 nt, Artificial Sequence
  derived and/or modified sequence opt1 from hemagglutinin__InfluenzaA__AEI87034
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccaucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67902 - RNA, 1701 nt, Artificial Sequence; identical to SEQ ID NO: 66592
  derived and/or modified sequence opt1 from hemagglutinin__InfluenzaA__AEI87044

SEQ ID NO: 67903 - RNA, 1701 nt, Artificial Sequence; identical to SEQ ID NO: 64841
  derived and/or modified sequence opt1 from hemagglutinin__InfluenzaA__AEI87054

SEQ ID NO: 67904 - RNA, 1701 nt, Artificial Sequence
  derived and/or modified sequence opt1 from hemagglutinin__InfluenzaA__AEI87064
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgcggccagcucccugguccucguggugagccugggggccaucagcuucuggaugugcuccaacggcagccugcagugccggaucugcaucuga

SEQ ID NO: 67905 - RNA, 1701 nt, Artificial Sequence
  derived and/or modified sequence opt1 from hemagglutinin__InfluenzaA__AEI87074
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacgaccgccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucacgaacaaggugaacagcgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 67906 - RNA, 1701 nt, Artificial Sequence
  derived and/or modified sequence opt1 from hemagglutinin__InfluenzaA__AEI87094
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacacgggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcaucaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 67907 - RNA, 1701 nt, Artificial Sequence; identical to SEQ ID NO: 67906
  derived and/or modified sequence opt1 from hemagglutinin__InfluenzaA__AEI87104

SEQ ID NO: 67908 - RNA, 1698 nt, Artificial Sequence; identical to SEQ ID NO: 64634
  derived and/or modified sequence opt1 from hemagglutinin__InfluenzaA__AEI91963

SEQ ID NO: 67909 - RNA, 1701 nt, Artificial Sequence; identical to SEQ ID NO: 64841
  derived and/or modified sequence opt1 from hemagglutinin__InfluenzaA__AEI91977

SEQ ID NO: 67910 - RNA, 1701 nt, Artificial Sequence; identical to SEQ ID NO: 66365
  derived and/or modified sequence opt1 from hemagglutinin__InfluenzaA__AEI91978

SEQ ID NO: 67911 - RNA, 1701 nt, Artificial Sequence; identical to SEQ ID NO: 65307
  derived and/or modified sequence opt1 from hemagglutinin__InfluenzaA__AEI91998

SEQ ID NO: 67912 - RNA, 1701 nt, Artificial Sequence
  derived and/or modified sequence opt1 from hemagglutinin__InfluenzaA__AEI91999
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccugaacgacaagcccuuccagaacgugaaccgcaucacguacggggcgugcccgcgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacaccaucgaccugacggacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 67913 - RNA, 1698 nt, Artificial Sequence
  derived and/or modified sequence opt1 from hemagglutinin__InfluenzaA__AEI92018
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucgccgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacagcaccguggccagcucccuggugcuccuggucagccugggcgccaucuccuucuggaugugcagcaacgggucccuccagugccggaucugcaucuga

SEQ ID NO: 67914 - RNA, 1701 nt, Artificial Sequence; identical to SEQ ID NO: 67889
  derived and/or modified sequence opt1 from hemagglutinin__InfluenzaA__AEJ10400

SEQ ID NO: 67915 - RNA, 1701 nt, Artificial Sequence
  derived and/or modified sequence opt1 from hemagglutinin__InfluenzaA__AEJ10410
augaagaccauccuggugguccuccuguacaccuucgccacggccaacgcggacacccugugcaucggcuaccacgccaacaacagcaccgacaccaucgacacggugcucgagaagaacgugaccgucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagacguccagcuccgacaacgggaccugcuaccccggcaacuucaucgacuacgaggagcuccgggagcagcugagcuccgugagcuccuucgagcgcuucgagaucuuccccaagaccagcuccuggagcgaccacgacuccaacaagggcgugaccgccgccugcccccacgccggcgccaagagcuucuacaagaaccugaucuggcucgucaagaaggggaacuccuacccgaagcugagcaagagcuacaucaacgacaagggcaaggaggugcuggugcucugggggauccaccaccccuccacgagcgcggaccagcagucccuguaccagaacgccgacgccuacgucuucgugggcaccagccgguacuccaagaaguucaagcccgagaucgccauccgccccaaggugcgggaccaggagggccgcaugaacuacuacuggacccuggucgagccgggggacaagaucaccuucgaggccacgggcaaccucguggcgccccgguacgccuucgccauggagcgcaacgccgggagcggcaucaucaucuccgacacccccgugcacgacugcaacacgaccugccagacccccaagggcgccaucaacaccagccugccguuccagaacauccaccccaucaccaucgggaagugccccaaguacgucaaguccaccaagcugcggcucgcgacgggccugcgcaacgugcccagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 67916 - RNA, 1701 nt, Artificial Sequence
  derived and/or modified sequence opt1 from hemagglutinin__InfluenzaA__AEJ10420
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggaccgccacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 67917 - RNA, 1701 nt, Artificial Sequence
  derived and/or modified sequence opt1 from hemagglutinin__InfluenzaA__AEJ10430
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 67918 - RNA, 1701 nt, Artificial Sequence
  derived and/or modified sequence opt1 from hemagglutinin__InfluenzaA__AEJ10440
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagauccuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 67919 - RNA, 1701 nt, Artificial Sequence; identical to SEQ ID NO: 67832
  derived and/or modified sequence opt1 from hemagglutinin__InfluenzaA__AEJ10450

SEQ ID NO: 67920 - RNA, 1701 nt, Artificial Sequence
  derived and/or modified sequence opt1 from hemagglutinin__InfluenzaA__AEJ10480
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccaguccgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacgcccagggcagcggguacgccgcggaccugaaguccacccagaacgccaucgacaagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggcgaagcucaaccgcgaggagaucgacggcgugaagcuggaguccacccggaucuaccagauccuggccaucuacagcaccgucgccagcucccucgugcugguggucagccugggggccaucuccuucuggaugugcagcaacggcucccuccagugccgcaucugcaucuga

SEQ ID NO: 67921 - RNA, 1701 nt, Artificial Sequence
  derived and/or modified sequence opt1 from hemagglutinin__InfluenzaA__AEJ10490
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggcggugcccgaaguacgugaaguccaccaagcugcgccucgccacgggccugcggaacguccccagcauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacggcaucaccaacaaggugaacagcgucaucgagaagaugaacacgcaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccaccaugaucuaccagauccuggccaucuacagcaccgucgcguccagccuggugcucaucgugagccugggcgccaucuccuucuggaugugcagcaacggcucccugcagugccggaucugcaucuga

SEQ ID NO: 67922 - RNA, 1701 nt, Artificial Sequence
  derived and/or modified sequence opt1 from hemagglutinin__InfluenzaA__AEJ10500
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaagggcuucuacaagaaccugaucuggcucgugaagaaggggaacuccuaccccaagcugaacaagagcuacaucaacgacaagggcaaggaggugcugguccucuggggcauccaccaccccuccaccacggccgaccagcagagccuguaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggcagcgggaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggcuucaucgagggcggguggaccgggaugguggacggcugguacggguaccaccaccagaacgagcagggcagcggcuacgccgccgaccucaaguccacccagaacgccaucgacaagaucacgaacaaggugaacagcgucaucgagaagaugaacacccaguucaccgcgguggggaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggcgccaucuccuucuggaugugcagcaacgggagccugcagugccggaucugcaucuga

SEQ ID NO: 67923 - RNA, 1701 nt, Artificial Sequence; identical to SEQ ID NO: 67875
  derived and/or modified sequence opt1 from hemagglutinin__InfluenzaA__AEJ10510

SEQ ID NO: 67924 - RNA, 1701 nt, Artificial Sequence
  derived and/or modified sequence opt1 from hemagglutinin__InfluenzaA__AEJ10520
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaacuacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugcagcaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 67925 - RNA, 1701 nt, Artificial Sequence; identical to SEQ ID NO: 63677
  derived and/or modified sequence opt1 from hemagglutinin__InfluenzaA__AEJ10530

SEQ ID NO: 67926 - RNA, 1701 nt, Artificial Sequence; identical to SEQ ID NO: 63677
  derived and/or modified sequence opt1 from hemagglutinin__InfluenzaA__AEJ10540

SEQ ID NO: 67927 - RNA, 1701 nt, Artificial Sequence; identical to SEQ ID NO: 63677
  derived and/or modified sequence opt1 from hemagglutinin__InfluenzaA__AEJ10550

SEQ ID NO: 67928 - RNA, 1701 nt, Artificial Sequence
  derived and/or modified sequence opt1 from hemagglutinin__InfluenzaA__AEJ10570
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacgacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacgcgaccugccagaccccgaagggcgccaucaacaccucccugcccuuccagaacauccaccccaucacgaucgggaagugccccaaguacgucaagagcaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgggaggagaucgacggcgugaagcuggagagcacccgcaucuaccagauccuggccaucuacuccaccgucgccagcagccucgugcugguggucucccugggggccaucagcuucuggaugugcuccaacggcagccuccagugccggaucugcaucuga

SEQ ID NO: 67929 - RNA, 1701 nt, Artificial Sequence; identical to SEQ ID NO: 67928
  derived and/or modified sequence opt1 from hemagglutinin__InfluenzaA__AEJ10580

SEQ ID NO: 67930 - RNA, 1701 nt, Artificial Sequence
  derived and/or modified sequence opt1 from hemagglutinin__InfluenzaA__AEJ36302
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccuacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagcggcuguaccagaacgccgacgccuacgccuucgugggcacgucccgcuacagcaagaaguucaagccggagaucgcgauccggcccaaggugcgcgaccaggagggccggaugaacuacuacuggacccuggucgagcccggggacaagaucaccuucgaggccaccggcaaccucguggugccccgcuacgccuucgccauggagcggaacgccggguccggcaucaucaucagcgacacgccggcgcacgacugcaacacgaccugccagacccccaagggcgccaucaacaccucccugcccuuccagaacguccaccccaucaccaucgggaagugcccgaaguacgucaagagcaccaagcugcgccucgccaccggccugcggaacgugcccuccauccagagccgcgggcuguucggcgccaucgccggguucaucgagggcggcuggacggggaugguggacggcugguacggguaccaccaccagaacgagcagggcuccggguacgcggccgaccucaagagcacccagaacgccuucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgcgaaggagaccgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggccaucuacuccaccguggccagcucccugguccucguggugagccugggggcgaucagcuucuggaugugcuccaacggcagccugcagugccgcaucugcaucuga

SEQ ID NO: 67931 - RNA, 1701 nt, Artificial Sequence
  derived and/or modified sequence opt1 from hemagglutinin__InfluenzaA__AEJ36312
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacauccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67932 - RNA, 1701 nt, Artificial Sequence
  derived and/or modified sequence opt1 from hemagglutinin__InfluenzaA__AEJ37853
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggaggccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacaugugcauggagagcgugaagaacgggaccuacgacuaccccaaguacuccgaggaggcgaagcugaaccgggaggagaucgacggcgugaagcucgagagcacccgcaucuaccagauccuggccaucuacuccacggucgccagcagccuggugcucguggucucccugggggccaucagcuucuggaugugcuccaacggcagccugcagugccggaucugcaucuga

SEQ ID NO: 67933 - RNA, 1701 nt, Artificial Sequence
  derived and/or modified sequence opt1 from hemagglutinin__InfluenzaA__AEJ37863
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagcugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 67934 - RNA, 1701 nt, Artificial Sequence; identical to SEQ ID NO: 64841
  derived and/or modified sequence opt1 from hemagglutinin__InfluenzaA__AEJ37873

SEQ ID NO: 67935 - RNA, 1701 nt, Artificial Sequence; identical to SEQ ID NO: 67889
  derived and/or modified sequence opt1 from hemagglutinin__InfluenzaA__AEJ37883

SEQ ID NO: 67936 - RNA, 1701 nt, Artificial Sequence
  derived and/or modified sequence opt1 from hemagglutinin__InfluenzaA__AEJ37893
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcaacuucaucgacuacgaggagcuccgggagcagcugagcuccgugagcuccuucgagcgcuucgagaucuuccccaagaccagcuccuggcccgaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggcgccccgguacgccuucgccauggagcgcaacgccggguccggcaucaucaucagcgacaagcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67937 - RNA, 1701 nt, Artificial Sequence; identical to SEQ ID NO: 67889
  derived and/or modified sequence opt1 from hemagglutinin__InfluenzaA__AEJ37903

SEQ ID NO: 67938 - RNA, 1701 nt, Artificial Sequence
  derived and/or modified sequence opt1 from hemagglutinin__InfluenzaA__AEJ37923
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccaucgagcgcauggccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 67939 - RNA, 1701 nt, Artificial Sequence
  derived and/or modified sequence opt1 from hemagglutinin__InfluenzaA__AEJ37943
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 67940 - RNA, 1701 nt, Artificial Sequence; identical to SEQ ID NO: 67889
  derived and/or modified sequence opt1 from hemagglutinin__InfluenzaA__AEJ37953

SEQ ID NO: 67941 - RNA, 1701 nt, Artificial Sequence
  derived and/or modified sequence opt1 from hemagglutinin__InfluenzaA__AEJ37963
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaccaacaccucccugcccuuccagaacauccaccccaucaccaucgggaagugccccaaguacgucaagagcaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 67942 - RNA, 1701 nt, Artificial Sequence; identical to SEQ ID NO: 64841
  derived and/or modified sequence opt1 from hemagglutinin__InfluenzaA__AEJ37973

SEQ ID NO: 67943 - RNA, 1701 nt, Artificial Sequence; identical to SEQ ID NO: 67889
  derived and/or modified sequence opt1 from hemagglutinin__InfluenzaA__AEJ37983

SEQ ID NO: 67944 - RNA, 1701 nt, Artificial Sequence; identical to SEQ ID NO: 66541
  derived and/or modified sequence opt1 from hemagglutinin__InfluenzaA__AEK21369

SEQ ID NO: 67945 - RNA, 1698 nt, Artificial Sequence; identical to SEQ ID NO: 64624
  derived and/or modified sequence opt1 from hemagglutinin__InfluenzaA__AEK21380

SEQ ID NO: 67946 - RNA, 1701 nt, Artificial Sequence
  derived and/or modified sequence opt1 from hemagglutinin__InfluenzaA__AEK21396
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccuccuggugccccgcuacgccuucgagauggagcggaaguccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcuccgccuggccaccggccugcggaacgugccgagcauccagucccgcggccucuucggggccaucgcgggguucaucgagggcggcuggacggggauggucgacggcugguacggguaccaccaccagaacgagcagggcagcggguacgccgccgaccugaaguccacccagaacgccaucgacgagaucaccaacaaggugaacagcgugaucgagaagaugaacacccaguucacggccgucggcaaggaguucaaccaccuggagaagcggaucgagaaccucaacaagaagguggacgacggcuuccuggacaucuggaccuacaacgcggagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgcgagaagaucgacggcgugaagcuggaguccacccggaucuaccagauccuggccaucuacagcaccguggccagcucccucguccugguggugagccugggggcgaucuccuucuggaugugcagcaacggcucccuccagugccgcaucugcaucuga

SEQ ID NO: 67947 - RNA, 1701 nt, Artificial Sequence
  derived and/or modified sequence opt1 from hemagglutinin__InfluenzaA__AEK21406
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccaugagcuccuucgagcgcuucgagaucuuccccaagaccagcuccuggcccgaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 67948 - RNA, 1701 nt, Artificial Sequence
  derived and/or modified sequence opt1 from hemagglutinin__InfluenzaA__AEK21416
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcguguucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccgugcgcccgaaggugcgggaccaggagggccgcaugaacuacuacuggacccuggucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 67949 - RNA, 1701 nt, Artificial Sequence
  derived and/or modified sequence opt1 from hemagglutinin__InfluenzaA__AEK21426
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgugcggagcaccaagcugcgccucgccaccggccugcggaacgugccguccauccagagccgcgggcuguucggcgccaucgccggguucaucgagggcggcuggacggggauggucgacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgcgaggagaucgacggcgugaagcucgagagcacccggaucuaccagauccuggccaucuacuccaccguggccagcagccugguccucguggugucccugggggccaucagcuucuggaugugcuccaacggcagccugcagugccgcaucugcaucuga

SEQ ID NO: 67950 - RNA, 1701 nt, Artificial Sequence; identical to SEQ ID NO: 64841
  derived and/or modified sequence opt1 from hemagglutinin__InfluenzaA__AEK21436

SEQ ID NO: 67951 - RNA, 1701 nt, Artificial Sequence
  derived and/or modified sequence opt1 from hemagglutinin__InfluenzaA__AEK21456
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagaacgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 67952 - RNA, 1701 nt, Artificial Sequence; identical to SEQ ID NO: 67889
  derived and/or modified sequence opt1 from hemagglutinin__InfluenzaA__AEK21466

SEQ ID NO: 67953 - RNA, 1701 nt, Artificial Sequence; identical to SEQ ID NO: 67889
  derived and/or modified sequence opt1 from hemagglutinin__InfluenzaA__AEK21476

SEQ ID NO: 67954 - RNA, 1701 nt, Artificial Sequence; identical to SEQ ID NO: 64841
  derived and/or modified sequence opt1 from hemagglutinin__InfluenzaA__AEK21486

SEQ ID NO: 67955 - RNA, 1701 nt, Artificial Sequence
  derived and/or modified sequence opt1 from hemagglutinin__InfluenzaA__AEK28774
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgauccaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 67956 - RNA, 1701 nt, Artificial Sequence
  derived and/or modified sequence opt1 from hemagglutinin__InfluenzaA__AEK28785
augaagaccaucaucgcccugagcuacauccucugccugguguucgcccagaaccugcccggcaacgacaacuccgcggccacccucugccuggggcaccacgccgucccgaacggcacgaucgugaagaccaucaccaacgaccagguggaggucaccaacgccacggagcuggugcagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggcguacagcaacugcuaccccuacgacgucccggacuacgccucccugcggagccucguggccuccagcggcacccuggaguucaacaacgaguccuucaacuggacgggggugacccagaacggcaccagcuccgccugcauccgccggagcaacaacuccuucuucagccgccugaacuggcucacccaccugaacuucaaguaccccgcgcugaacgucacgaugcccaacaacgagcaguucgacaagcucuacaucuggggcgugcaccaccccgggaccgacaaggaccagaucuuccuguacgcccaggccuccgggcggaucaccgugagcaccaagcgcucccagcaggccgucaucccgaacaucggcagccggccccgcgugcggaacauccccagccgcaucuccaucuacuggacgaucgugaagcccggcgacauccugcucaucaacagcaccgggaaccugaucgccccgcggggcuacuucaagauccgcuccggcaagagcuccaucaugcggagcgacgcgcccaucgggaagugcaacuccgagugcaucacccccaacggcagcauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacccaggccgccaucgaccagaucaacgggaagcugaaccgccugaucggcaagacgaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccauccaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 67957 - RNA, 1701 nt, Artificial Sequence
  derived and/or modified sequence opt1 from hemagglutinin__InfluenzaA__AEK28796
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgacaagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgcggguccaagaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgccaucccgaacaucggcagccgcccccgggugcgcaacauccccucccggaucagcaucuacuggaccaucgucaagcccggggacauccugcucaucaacuccaccggcaaccugaucgccccgcgcggguacuucaagauccggagcggcaaguccagcaucaugcgcuccgacgcgcccaucggcaagugcaacagcgagugcaucacccccaacggguccauccccaacgacaagccguuccagaacgugaaccggaucacguacggcgccugcccccgcuacgugaagcagaacacccugaagcucgccaccgggaugcggaacguccccgagaagcagacccgcggcaucuucggggccaucgccggcuucaucgagaacggcugggaggggaugguggacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcgcuggagaaccagcacaccauccaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 67958 - RNA, 1701 nt, Artificial Sequence
  derived and/or modified sequence opt1 from hemagglutinin__InfluenzaA__AEK28807
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacggcaacugcuaccccuacgacgugccggacuacgcgucccugcggagccucgucgccuccagcgggacgcuggaguucaacaacgaguccuucaacuggaccggcgugacccagaacgggaccagcuccgccugcauccgcaagagcaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccggccgcaucaccgugagcacgaagcggucccagcagaccgugaucccgaacaucggcagccgcccccggguccgcaacauccccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggccgcgggcaggccgccgaccugaaguccacccaggcggccaucgaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgauccaccucaccgacuccgagaugaacaagcuguucgagaagaccaagaagcagcugcgggagaacgccgaggacaugggcaacgggugcuucaagaucuaccacaagugcgacaacgcgugcaucggcagcauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 67959 - RNA, 1701 nt, Artificial Sequence
  derived and/or modified sequence opt1 from hemagglutinin__InfluenzaA__AEK28818
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacaacaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgauccaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 67960 - RNA, 1701 nt, Artificial Sequence
  derived and/or modified sequence opt1 from hemagglutinin__InfluenzaA__AEK28828
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccgggacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggucugccagaaggggaacauccggugcaacaucugcaucuga

SEQ ID NO: 67961 - RNA, 1701 nt, Artificial Sequence; identical to SEQ ID NO: 63442
  derived and/or modified sequence opt1 from hemagglutinin__InfluenzaA__AEK28839

SEQ ID NO: 67962 - RNA, 1701 nt, Artificial Sequence
  derived and/or modified sequence opt1 from hemagglutinin__InfluenzaA__AEK28850
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggcugcgcguccggaacauccccucccgcaucagcaucuacuggaccaucgugaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 67963 - RNA, 1701 nt, Artificial Sequence
  derived and/or modified sequence opt1 from hemagglutinin__InfluenzaA__AEK28861
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugaaggagaacgccgaggacauggggaacggcugcuucaagaucuaccacaagugcgacaacgcgugcaucggguccauccgcaacggcaccuacgaccacgacgucuaccgcgacgaggcccucaacaaccgguuccacaucaaggggguggagcugaaguccggcuacaaggacuggauccuguggaucuccuucgccacgagcugcuuccuccugugcguggcccugcucggcuucaucaugugggccugccagaaggggaacauccgcugcaacaucugcaucuga

SEQ ID NO: 67964 - RNA, 1701 nt, Artificial Sequence
  derived and/or modified sequence opt1 from hemagglutinin__InfluenzaA__AEK28872
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccgggacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67965 - RNA, 1701 nt, Artificial Sequence
  derived and/or modified sequence opt1 from hemagglutinin__InfluenzaA__AEK28883
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccagcaacuccuucuucagccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccuccgggcggaucaccgucagcacgaagcgcagccagcagaccgugaucccgaacaucggcucccggccccgcgugcggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgauccaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 67966 - RNA, 1701 nt, Artificial Sequence
  derived and/or modified sequence opt1 from hemagglutinin__InfluenzaA__AEK28894
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67967 - RNA, 1701 nt, Artificial Sequence
  derived and/or modified sequence opt1 from hemagglutinin__InfluenzaA__AEK28905
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcucuacaucuggggcguccaccaccccgggaccgacaacgaccagaucuucccguacgcgcaggccagcgggcgcaucaccguguccacgaagcggagccagcagaccgugauccccaacaucggcagccgcccccggguccgcaacauccccucccggaucagcaucuacuggaccaucgugaagccgggcgacauccugcugaucaacuccaccgggaaccucaucgcgccccgcggcuacuucaagauccggagcgggaaguccagcaucaugcgcuccgacgcccccaucggcaagugcaacagcgagugcaucacgcccaacggcuccaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 67968 - RNA, 1701 nt, Artificial Sequence
  derived and/or modified sequence opt1 from hemagglutinin__InfluenzaA__AEK28916
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcgugaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67969 - RNA, 1701 nt, Artificial Sequence
  derived and/or modified sequence opt1 from hemagglutinin__InfluenzaA__AEK28927
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgauccaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67970 - RNA, 1701 nt, Artificial Sequence
  derived and/or modified sequence opt1 from hemagglutinin__InfluenzaA__AEK28949
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugccucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 67971 - RNA, 1701 nt, Artificial Sequence; identical to SEQ ID NO: 63442
  derived and/or modified sequence opt1 from hemagglutinin__InfluenzaA__AEK28960

SEQ ID NO: 67972 - RNA, 1701 nt, Artificial Sequence; identical to SEQ ID NO: 63442
  derived and/or modified sequence opt1 from hemagglutinin__InfluenzaA__AEK28971

SEQ ID NO: 67973 - RNA, 1701 nt, Artificial Sequence
  derived and/or modified sequence opt1 from hemagglutinin__InfluenzaA__AEK28982
augaagaccaucaucgcccugagcuacauccucugccugguguucgcccagaagcugcccggcaacuacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgauccaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67974 - RNA, 1701 nt, Artificial Sequence
  derived and/or modified sequence opt1 from hemagglutinin__InfluenzaA__AEK28993
augaagaccaucaucgcccugagcuacauccucugccugguguucgcccagaagcugcccggcaacuacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 67975 - RNA, 1701 nt, Artificial Sequence
  derived and/or modified sequence opt1 from hemagglutinin__InfluenzaA__AEK29004
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgucagccugcggucccucguggcgagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcccaggcgagcgggcggaucaccguguccacgaagcgcagccagcaggccgucaucccgaacaucggcagccggccccgcgugcggaacauccccucccgcgugagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgccugcaucacccccaacggcuccauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 67976 - RNA, 1701 nt, Artificial Sequence
  derived and/or modified sequence opt1 from hemagglutinin__InfluenzaA__AEK29026
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccaggacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguacagcgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcagaccgugauccccaacaucggcucccggccgcgcguccggaacauccccagccgcaucuccaucuacuggaccaucgugaagcccggcgacauccugcucaucaacagcaccgggaaccugaucgcgccccggggcuacuucaagaugcaguccgggaaguccuccaucaugcgcagcgacgccccgaucggcaagugcaacuccgagugcaucacgcccaacggcagcauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 67977 - RNA, 1701 nt, Artificial Sequence
  derived and/or modified sequence opt1 from hemagglutinin__InfluenzaA__AEK29048
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccgggguggcccagaacggcaccuccagcgccugcauccgccgguccaacaacagcuucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccgccgggcggaucaccgugagcaccaagcgcucccagcaggccgugaucccgaacaucggcagccggccccgcguccggaacauccccagccgcguguccaucuacuggacgaucgugaagcccggcgacauccugcucaucaacagcaccgggaaccugaucgcgccgcggggcuacuucaagauccgcuccgggaaguccuccaucaugcggagcgacgcccccaucggcaagugcaacuccgccugcaucacccccaacggcagcauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgcgaucgccggguucaucgagaacggcugggagggcauggucgacgggugguacggcuuccgccaccagaacuccgaggggcggggccaggccgccgaccucaagagcacccaggccgcgaucgaccagaucaacgggaagcugaaccgccugaucggcaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacguguaccgggacgaggcgcucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 67978 - RNA, 1701 nt, Artificial Sequence
  derived and/or modified sequence opt1 from hemagglutinin__InfluenzaA__AEK29070
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccauccaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 67979 - RNA, 1701 nt, Artificial Sequence
  derived and/or modified sequence opt1 from hemagglutinin__InfluenzaA__AEK29081
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcuccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccaggcguccgggcggaucaccgugagcacgaagcgcagccagcaggccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccauccaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 67980 - RNA, 1701 nt, Artificial Sequence; identical to SEQ ID NO: 66541
  derived and/or modified sequence opt1 from hemagglutinin__InfluenzaA__AEK29092

SEQ ID NO: 67981 - RNA, 1701 nt, Artificial Sequence; identical to SEQ ID NO: 67863
  derived and/or modified sequence opt1 from hemagglutinin__InfluenzaA__AEK29125

SEQ ID NO: 67982 - RNA, 1701 nt, Artificial Sequence; identical to SEQ ID NO: 67863
  derived and/or modified sequence opt1 from hemagglutinin__InfluenzaA__AEK29136

SEQ ID NO: 67983 - RNA, 1701 nt, Artificial Sequence; identical to SEQ ID NO: 67863
  derived and/or modified sequence opt1 from hemagglutinin__InfluenzaA__AEK29169

SEQ ID NO: 67984 - RNA, 1701 nt, Artificial Sequence; identical to SEQ ID NO: 67863
  derived and/or modified sequence opt1 from hemagglutinin__InfluenzaA__AEK29180

SEQ ID NO: 67985 - RNA, 1701 nt, Artificial Sequence; identical to SEQ ID NO: 67863
  derived and/or modified sequence opt1 from hemagglutinin__InfluenzaA__AEK29191

SEQ ID NO: 67986 - RNA, 1701 nt, Artificial Sequence; identical to SEQ ID NO: 67863
  derived and/or modified sequence opt1 from hemagglutinin__InfluenzaA__AEK29202

SEQ ID NO: 67987 - RNA, 1701 nt, Artificial Sequence; identical to SEQ ID NO: 67863
  derived and/or modified sequence opt1 from hemagglutinin__InfluenzaA__AEK29213

SEQ ID NO: 67988 - RNA, 1701 nt, Artificial Sequence; identical to SEQ ID NO: 67863
  derived and/or modified sequence opt1 from hemagglutinin__InfluenzaA__AEK29224

SEQ ID NO: 67989 - RNA, 1701 nt, Artificial Sequence; identical to SEQ ID NO: 67863
  derived and/or modified sequence opt1 from hemagglutinin__InfluenzaA__AEK29235

SEQ ID NO: 67990 - RNA, 1701 nt, Artificial Sequence
  derived and/or modified sequence opt1 from hemagglutinin__InfluenzaA__AEK29268
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 67991 - RNA, 1698 nt, Artificial Sequence
  derived and/or modified sequence opt1 from hemagglutinin__InfluenzaA__AEK59838
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccgaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagcaagaaguucacgcccgagaucgccaagcgccccaaggugcgggaccaggagggccgcaucaacuacuacuggacccuccuggagcccgggaacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 67992 - RNA, 1701 nt, Artificial Sequence
  derived and/or modified sequence opt1 from hemagglutinin__InfluenzaA__AEK98378
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccagcgggcggaucaccguguccacgaagcgcagccagcagaccgugauccccaacaucggcagccggccccgcguccggaacauccccucccgcaucagcaucuacuggaccaucgugaagccgggcgacauccugcugaucaacuccaccgggaaccucaucgcgccccggggcuacuucaagauccagagcgggaaguccagcaucaugcgcuccgacgcccccaucggcaagugcaacagcgagugcaucacgcccaacggcuccaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggccaucgaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaaggggguggagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 67993 - RNA, 1701 nt, Artificial Sequence; identical to SEQ ID NO: 62923
  derived and/or modified sequence opt1 from hemagglutinin__InfluenzaA__AEK98380

SEQ ID NO: 67994 - RNA, 1701 nt, Artificial Sequence
  derived and/or modified sequence opt1 from hemagglutinin__InfluenzaA__AEK98382
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcauccggaacauccccagccgcaucuccaucuacuggaccaucgucaagcccggcgacauccugcucaucaacagcaccgggaaccugaucgccccgcggggcuacuucaagauccagaucgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 67995 - RNA, 1701 nt, Artificial Sequence
  derived and/or modified sequence opt1 from hemagglutinin__InfluenzaA__AEK98386
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggacccgcguccggaacauccccucccgcgugagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgccugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 67996 - RNA, 1701 nt, Artificial Sequence
  derived and/or modified sequence opt1 from hemagglutinin__InfluenzaA__AEK98388
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggccugcagaacaagaagugggaccuguucguggagcgcagcaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaagaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccuccugaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 67997 - RNA, 1701 nt, Artificial Sequence
  derived and/or modified sequence opt1 from hemagglutinin__InfluenzaA__AEK98390
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaagagcgcgugcaucacccccaacggcuccauccccaacgacaagacguuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 67998 - RNA, 1701 nt, Artificial Sequence
  derived and/or modified sequence opt1 from hemagglutinin__InfluenzaA__AEK98392
augaagaccaucaucgcccugagcuacauccucugccugguguucgcccagaagcugcccggcaacgacaacuccaccgcgacgcucugccuggggcaccacgccgucccgaacggcaccaucgugaagaccaucaccgacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagaacuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggcugcgcguccggaacauccccagccgcguguccaucuacuggaccaucgugaagcccggcgacauccuccugaucaacagcaccgggaaccugaucgcgccccggggcuacuucaagauccgcuccgggaaguccuccaucaugcggagcgacgccccgaucggcaagugcaacuccgccugcaucacccccaacggcagcauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccucuggagcuacaacgccgagcugcuggucgcgcucgagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcugaaguccggcuacaaggacuggauccucuggaucagcuucgccaucuccugcuuccugcugugcgucgcgcuccugggcuucaucaugugggccugccagaaggggaacauccggugcaacaucugcaucuga

SEQ ID NO: 67999 - RNA, 1701 nt, Artificial Sequence
  derived and/or modified sequence opt1 from hemagglutinin__InfluenzaA__AEK98394
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggcugcgcguccggaacauccccucccgcgugagcaucuacuggaccaucgugaagcccggcgacauccuccugaucaacuccaccgggaaccugaucgcgccccggggcuacuucaagauccgcagcgggaaguccagcaucaugcgguccgacgccccgaucggcaagugcaacagcgccugcaucacccccaacggcuccauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 68000 - RNA, 1701 nt, Artificial Sequence
  derived and/or modified sequence opt1 from hemagglutinin__InfluenzaA__AEK98396
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaagagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucagccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 68001 - RNA, 1701 nt, Artificial Sequence
  derived and/or modified sequence opt1 from hemagglutinin__InfluenzaA__AEK98398
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggccugcagaacaagaagugggaccuguucguggagcgcagcaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaagaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccuccugaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccucaagcuggccaccggcaugcgcaacauccccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggaucaucuggaucuccuucgccaucagcugcuuccuccugugcgucgcccugcucggcuucaucaugugggcgugccagaaggggaacauccggugcaacaucugcaucuga

SEQ ID NO: 68002 - RNA, 1701 nt, Artificial Sequence
  derived and/or modified sequence opt1 from hemagglutinin__InfluenzaA__AEK98400
auggagaccaucaucgcccugagcuacauccucucccugguguucgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgagaacuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgaggaguucgacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcagcuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgagaucgagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 68003 - RNA, 1701 nt, Artificial Sequence
  derived and/or modified sequence opt1 from hemagglutinin__InfluenzaA__AEK98402
augaagaccaucaucgcccugagcuacauccucugccugggcuucgcccagaagcugcccgggaacgacaacuccaccgcgacgcucugccugggccaccacgccgugccgaacgggaccaucgucaagaccaucaccaacgaccagaucgaggugacgaacgccaccgagcuggugcagagcuccagcaccggcgagaucugcgacagcccccaccagauccucgacgggaagaacugcacccugaucgacgcccugcucggcgacccccagugcgacggcuuccagaacaagaagugggaccuguucgucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcggccggaucaccgucuccacgaagcgcagccagcagaccgccaucccgaacaucggcagccggccccgcgugcggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggccgggggcaggccgcggaccugaaguccacccaggccgccaucaaccagaucaacggcaagcugaaccgccucaucggcaagaccaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggcgugccagaagggcaacauccggugcaacaucugcaucuga

SEQ ID NO: 68004 - RNA, 1701 nt, Artificial Sequence
  derived and/or modified sequence opt1 from hemagglutinin__InfluenzaA__AEK98404
augaagaccaucaucgcccugagcuacauccucucccugguguucgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgagaacuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgaggaguucgacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagaugcggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 68005 - RNA, 1701 nt, Artificial Sequence
  derived and/or modified sequence opt1 from hemagglutinin__InfluenzaA__AEK98406
augaagaccaucaucgcccugagcuacauccucucccugguguucgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgagaacuucaacuggaccggggugacccagaacggcaccuccagcgccugcauccgccgguccaacaacagcuucuucucccgccugaacuggcucacgcaccuccgguucaaguaccccgcccugaacgugaccaugcccaacaacgaggagcuggacaagcuguacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccuccugaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcugugcguggcccuccugggcuucgucaugugggccugccagaaggggaacauccggugcaacaucugcaucuga

SEQ ID NO: 68006 - RNA, 1701 nt, Artificial Sequence
  derived and/or modified sequence opt1 from hemagglutinin__InfluenzaA__AEL11687
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcuccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgugaccgacaacgaccagauccggcuguacgcccaggcguccgggcgcaucaccgugagcacgaagcggagccagcagaccgucaucccgaacaucggcuaccgcccccgggugcgcgacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgucaaccggaucaccuacggggccugcccccgcuacgugaagcagaacacccugaagcucgccaccggcaugcggaacgugcccgagaagcagacgcgcgggaucuucggcgcgaucgccggguucaucgagaacggcugggagggcauggucgacgggugguacggcuuccggcaccagaacagcgaggggaucggccaggccgccgaccugaaguccacccaggccgcgaucaaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagcgcaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaaggggguggagcugaaguccggcuacaaggacuggauccuguggaucuccuucgccaucagcugcuuccuccugugcgucgugcugcucggcuucaucaugugggccugccagaaggggaacauccgcugcaacaucugcaucuga

SEQ ID NO: 68007 - RNA, 1692 nt, Artificial Sequence
  derived and/or modified sequence opt1 from hemagglutinin__InfluenzaA__AEL31632
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccggcgucagcuccgugugccccuaccagggccgcagcuccuucuuccggaacguggucuggcugaccaagaaggacaacgccuaccccacgaucaagcgcagcuacaacaacaccaaccaggaggaccugcuggugcucugggggauccaccaccccaacgacgcggccgagcagacccggcuguaccagaacccgaccacguacaucuccgugggcaccagcacccugaaccagcgccucguccccaagaucgccacccgguccaaggugaacgggcagagcggccgcauggaguucuucuggacgauccugaaguccaacgacgccaucaacuucgagagcaacgggaacuucaucgcgcccgagaacgccuacaagaucgugaagaagggcgacagcaccaucaugaaguccgagcuggaguacggcaacugcaacaccaagugccagacccccaucggggccaucaacagcuccaugccguuccacaacauccacccccucacgaucggcgagugccccaaguacgucaagagcaaccggcuggugcuggccaccgggcuccgcaacuccccgcagggcgagacccggggccuguucggggccaucgcgggcuucaucgagggcggguggcaggggaugguggacggcugguacggcuaccaccacagcaacgagcagggguccggcuacgccgccgacaaggagagcacccagaaggccaucgacggggucacgaacaaggugaacuccaucaucgacaagaugaacacccaguucgaggccgugggccgcgaguucaacaaccuggagcggcgcaucgagaaccucaacaagaagauggaggacggguuccuggacgucuggaccuacaacgcggagcugcucgugcugauggagaacgagcggacccuggacuuccacgacagcaacgucaagaaccucuacgacaaggugcgccugcagcugcgggacaacgccaaggagcucggcaacggcugcuucgaguucuaccaccgcugcgacaacgagugcauggaguccgugcggaacgggacguacgacuacccgcaguacagcgaggaggcccgccugaagcgggaggagaucuccggcgucaagcuggagagcaucgggaccuaccagauccucuccaucuacagcaccguggccuccagccuggcccuggcgaucaugguggccggccucuuccuguggaugugcuccaacgggagccugcagugccgcaucugcaucuga

SEQ ID NO: 68008 - RNA, 1701 nt, Artificial Sequence; identical to SEQ ID NO: 67928
  derived and/or modified sequence opt1 from hemagglutinin__InfluenzaA__AEL89297

SEQ ID NO: 68009 - RNA, 1701 nt, Artificial Sequence; identical to SEQ ID NO: 67928
  derived and/or modified sequence opt1 from hemagglutinin__InfluenzaA__AEL89307

SEQ ID NO: 68010 - RNA, 1701 nt, Artificial Sequence; identical to SEQ ID NO: 67928
  derived and/or modified sequence opt1 from hemagglutinin__InfluenzaA__AEL89317

SEQ ID NO: 68011 - RNA, 1701 nt, Artificial Sequence; identical to SEQ ID NO: 67928
  derived and/or modified sequence opt1 from hemagglutinin__InfluenzaA__AEL89327

SEQ ID NO: 68012 - RNA, 1701 nt, Artificial Sequence; identical to SEQ ID NO: 67928
  derived and/or modified sequence opt1 from hemagglutinin__InfluenzaA__AEL89337

SEQ ID NO: 68013 - RNA, 1701 nt, Artificial Sequence; identical to SEQ ID NO: 67928
  derived and/or modified sequence opt1 from hemagglutinin__InfluenzaA__AEL89347

SEQ ID NO: 68014 - RNA, 1701 nt, Artificial Sequence; identical to SEQ ID NO: 67928
  derived and/or modified sequence opt1 from hemagglutinin__InfluenzaA__AEL89357

SEQ ID NO: 68015 - RNA, 1701 nt, Artificial Sequence; identical to SEQ ID NO: 67928
  derived and/or modified sequence opt1 from hemagglutinin__InfluenzaA__AEL89367

SEQ ID NO: 68016 - RNA, 1701 nt, Artificial Sequence; identical to SEQ ID NO: 67928
  derived and/or modified sequence opt1 from hemagglutinin__InfluenzaA__AEL89391

SEQ ID NO: 68017 - RNA, 1701 nt, Artificial Sequence; identical to SEQ ID NO: 67928
  derived and/or modified sequence opt1 from hemagglutinin__InfluenzaA__AEL89401

SEQ ID NO: 68018 - RNA, 1701 nt, Artificial Sequence; identical to SEQ ID NO: 67928
  derived and/or modified sequence opt1 from hemagglutinin__InfluenzaA__AEL89411

SEQ ID NO: 68019 - RNA, 1701 nt, Artificial Sequence; identical to SEQ ID NO: 67928
  derived and/or modified sequence opt1 from hemagglutinin__InfluenzaA__AEL89421

SEQ ID NO: 68020 - RNA, 1701 nt, Artificial Sequence; identical to SEQ ID NO: 67928
  derived and/or modified sequence opt1 from hemagglutinin__InfluenzaA__AEL89441

SEQ ID NO: 68021 - RNA, 1701 nt, Artificial Sequence; identical to SEQ ID NO: 67928
  derived and/or modified sequence opt1 from hemagglutinin__InfluenzaA__AEL89451

SEQ ID NO: 68022 - RNA, 1701 nt, Artificial Sequence; identical to SEQ ID NO: 67928
  derived and/or modified sequence opt1 from hemagglutinin__InfluenzaA__AEL89461

SEQ ID NO: 68023 - RNA, 1701 nt, Artificial Sequence; identical to SEQ ID NO: 67928
  derived and/or modified sequence opt1 from hemagglutinin__InfluenzaA__AEL89471

SEQ ID NO: 68024 - RNA, 1701 nt, Artificial Sequence
  derived and/or modified sequence opt1 from hemagglutinin__InfluenzaA__AEL89481
augaaggugauccuggucgugcuccuguacaccuucgccaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 68025 - RNA, 1701 nt, Artificial Sequence; identical to SEQ ID NO: 66592
  derived and/or modified sequence opt1 from hemagglutinin__InfluenzaA__AEL89491

SEQ ID NO: 68026 - RNA, 1701 nt, Artificial Sequence
  derived and/or modified sequence opt1 from hemagglutinin__InfluenzaA__AEL89501
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacgagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68027 - RNA, 1701 nt, Artificial Sequence; identical to SEQ ID NO: 64841
  derived and/or modified sequence opt1 from hemagglutinin__InfluenzaA__AEL89511

SEQ ID NO: 68028 - RNA, 1701 nt, Artificial Sequence; identical to SEQ ID NO: 66592
  derived and/or modified sequence opt1 from hemagglutinin__InfluenzaA__AEL89521

SEQ ID NO: 68029 - RNA, 1701 nt, Artificial Sequence
  derived and/or modified sequence opt1 from hemagglutinin__InfluenzaA__AEL89531
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugccagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagauguuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68030 - RNA, 1701 nt, Artificial Sequence; identical to SEQ ID NO: 66592
  derived and/or modified sequence opt1 from hemagglutinin__InfluenzaA__AEL89541

SEQ ID NO: 68031 - RNA, 1701 nt, Artificial Sequence
  derived and/or modified sequence opt1 from hemagglutinin__InfluenzaA__AEL89551
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 68032 - RNA, 1701 nt, Artificial Sequence
  derived and/or modified sequence opt1 from hemagglutinin__InfluenzaA__AEL89561
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccgaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcaccgagaucuaccagauccuggcgaucuacuccaccgucgccagcagccuggugcucguggucucccugggcgccaucagcuucuggaugugcuccaacggcagccugcagugccgcaucugcaucuga

SEQ ID NO: 68033 - RNA, 1701 nt, Artificial Sequence; identical to SEQ ID NO: 66592
  derived and/or modified sequence opt1 from hemagglutinin__InfluenzaA__AEL89571

SEQ ID NO: 68034 - RNA, 1701 nt, Artificial Sequence
  derived and/or modified sequence opt1 from hemagglutinin__InfluenzaA__AEL89581
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68035 - RNA, 1701 nt, Artificial Sequence; identical to SEQ ID NO: 67462
  derived and/or modified sequence opt1 from hemagglutinin__InfluenzaA__AEL89591

SEQ ID NO: 68036 - RNA, 1701 nt, Artificial Sequence
  derived and/or modified sequence opt1 from hemagglutinin__InfluenzaA__AEL89601
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaaggugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 68037 - RNA, 1701 nt, Artificial Sequence; identical to SEQ ID NO: 67462
  derived and/or modified sequence opt1 from hemagglutinin__InfluenzaA__AEL89611

SEQ ID NO: 68038 - RNA, 1701 nt, Artificial Sequence; identical to SEQ ID NO: 67904
  derived and/or modified sequence opt1 from hemagglutinin__InfluenzaA__AEL89621

SEQ ID NO: 68039 - RNA, 1701 nt, Artificial Sequence; identical to SEQ ID NO: 66592
  derived and/or modified sequence opt1 from hemagglutinin__InfluenzaA__AEL89631

SEQ ID NO: 68040 - RNA, 1701 nt, Artificial Sequence; identical to SEQ ID NO: 67928
  derived and/or modified sequence opt1 from hemagglutinin__InfluenzaA__AEL89641

SEQ ID NO: 68041 - RNA, 1701 nt, Artificial Sequence
  derived and/or modified sequence opt1 from hemagglutinin__InfluenzaA__AEL89651
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcguguucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguucgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcucccuggugcucgucgugagccugggggccaucagcuucuggaugugcuccaacggcagccugcagugccggaucugcaucuga

SEQ ID NO: 68042 - RNA, 1701 nt, Artificial Sequence; identical to SEQ ID NO: 67443
  derived and/or modified sequence opt1 from hemagglutinin__InfluenzaA__AEL89661

SEQ ID NO: 68043 - RNA, 1701 nt, Artificial Sequence
  derived and/or modified sequence opt1 from hemagglutinin__InfluenzaA__AEL89671
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagagcgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 68044 - RNA, 1701 nt, Artificial Sequence; identical to SEQ ID NO: 67443
  derived and/or modified sequence opt1 from hemagglutinin__InfluenzaA__AEL89691

SEQ ID NO: 68045 - RNA, 1701 nt, Artificial Sequence
  derived and/or modified sequence opt1 from hemagglutinin__InfluenzaA__AEL89701
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagaaccuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacaccccggugcacgacugcaacacgaccugccagacccccaagggcgccaucaacaccucccugcccuuccagaacauccaccccaucaccaucgggaagugcccgaaguacgucaagagcaccaagcugcggcucgccacgggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacggcaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcaccaugaucuaccagauccuggccaucuacuccaccgucgcgagcucccuggugcucguggucagccugggcgccaucagcuucuggaugugcuccaacggcagccugcagugccgcaucugcaucuga

SEQ ID NO: 68046 - RNA, 1701 nt, Artificial Sequence; identical to SEQ ID NO: 68045
  derived and/or modified sequence opt1 from hemagglutinin__InfluenzaA__AEL89711

SEQ ID NO: 68047 - RNA, 1701 nt, Artificial Sequence; identical to SEQ ID NO: 67443
  derived and/or modified sequence opt1 from hemagglutinin__InfluenzaA__AEL89721

SEQ ID NO: 68048 - RNA, 1701 nt, Artificial Sequence
  derived and/or modified sequence opt1 from hemagglutinin__InfluenzaA__AEL89741
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacaccuacguguucgugggcaccagccgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgccuucgcgauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 68049 - RNA, 1701 nt, Artificial Sequence; identical to SEQ ID NO: 66592
  derived and/or modified sequence opt1 from hemagglutinin__InfluenzaA__AEL89751

SEQ ID NO: 68050 - RNA, 1701 nt, Artificial Sequence
  derived and/or modified sequence opt1 from hemagglutinin__InfluenzaA__AEL89761
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccaccaugaucuaccagauccuggccaucuacagcaccgucgcguccagccuggugcucguggucagccugggcgccaucuccuucuggaugugcagcaacggcucccugcagugccgcaucugcaucuga

SEQ ID NO: 68051 - RNA, 1701 nt, Artificial Sequence; identical to SEQ ID NO: 67928
  derived and/or modified sequence opt1 from hemagglutinin__InfluenzaA__AEL89771

SEQ ID NO: 68052 - RNA, 1701 nt, Artificial Sequence; identical to SEQ ID NO: 68050
  derived and/or modified sequence opt1 from hemagglutinin__InfluenzaA__AEL89781

SEQ ID NO: 68053 - RNA, 1701 nt, Artificial Sequence; identical to SEQ ID NO: 67443
  derived and/or modified sequence opt1 from hemagglutinin__InfluenzaA__AEL89791

SEQ ID NO: 68054 - RNA, 1701 nt, Artificial Sequence
  derived and/or modified sequence opt1 from hemagglutinin__InfluenzaA__AEL89801
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcguguucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccgugcgcccgaaggugcgggaccaggagggccgcaugaacuacuacuggacccuggucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcucccugauccucgucgugagccugggggccaucagcuucuggaugugcuccaacggcagccugcagugccggaucugcaucuga

SEQ ID NO: 68055 - RNA, 1701 nt, Artificial Sequence
  derived and/or modified sequence opt1 from hemagglutinin__InfluenzaA__AEL89812
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacgcgaccugccagacccccaagggcgugaucaacacgagccugcccuuccagaacauccaccccaucaccaucgggaagugcccgaaguacgucaaguccaccaagcugcggcucgccaccggccugcgcaacgugcccagcauccagucccgggggcuguucggcgccaucgccggguucaucgagggcggcuggacggggaugguggacggcugguacggguaccaccaccagaacgagcagggcagcggguacgccgccgaccucaaguccacccagaacgccaucgacggcaucaccaacaaggucaacagcgugaucgagaagaugaacacccaguucacggcggucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggucaagcucgaguccaccaugaucuaccagauccuggccaucuacagcaccguggcguccagccuggugcucgucgugagccugggcgccaucuccuucuggaugugcagcaacggcucccugcagugccgcaucugcaucuga

SEQ ID NO: 68056 - RNA, 1701 nt, Artificial Sequence; identical to SEQ ID NO: 67443
  derived and/or modified sequence opt1 from hemagglutinin__InfluenzaA__AEL89832

SEQ ID NO: 68057 - RNA, 1701 nt, Artificial Sequence
  derived and/or modified sequence opt1 from hemagglutinin__InfluenzaA__AEL89842
augaaggccauccuggugguccuccuguacacccuggccaccgcgaacgccgacacgcucugcaucggcuaccacgccaacaacagcaccgacaccguggacaccgugcuggagaagaacgucacggugacccacuccgugaaccugcucgaggacaagcacgacgggaagcugugcaagcugcgcggcgucgcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacgcgaccugccagaccccgaagggcgccaucaacaccucccugcccuuccagaacgugcaccccaucacgaucgggaagugccccaaguacgucaagagcaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacaagaucaccaacaaggucaacuccgugaucgagaagaugaacacccaguucaccgccgucggcaaggaguucaaccaccuggagaagcgcaucgagaaccucaacaagaagguggacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgggaggagaucgacggcgucaagcuggagagcacccgcaucuaccagauccuggccaucuacuccaccguggccagcagccucgugcuggucgugucccugggggccaucagcuucuggaugugcuccaacggcagccuccagugccggaucugcaucuga

SEQ ID NO: 68058 - RNA, 1701 nt, Artificial Sequence
  derived and/or modified sequence opt1 from hemagglutinin__InfluenzaA__AEL89852
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 68059 - RNA, 1701 nt, Artificial Sequence; identical to SEQ ID NO: 67462
  derived and/or modified sequence opt1 from hemagglutinin__InfluenzaA__AEL93568

SEQ ID NO: 68060 - RNA, 1701 nt, Artificial Sequence; identical to SEQ ID NO: 67443
  derived and/or modified sequence opt1 from hemagglutinin__InfluenzaA__AEL93578

SEQ ID NO: 68061 - RNA, 1701 nt, Artificial Sequence
  derived and/or modified sequence opt1 from hemagglutinin__InfluenzaA__AEL93598
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcguguucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcucccuggugcucgucgugagccugggggccaucagcuucuggaugugcuccaacggcagccugcagugccggaucugcaucuga

SEQ ID NO: 68062 - RNA, 1701 nt, Artificial Sequence
  derived and/or modified sequence opt1 from hemagglutinin__InfluenzaA__AEL93618
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccacggccgaccagcagucccucuaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccgggagcggcaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgccaucuacuccaccgucgcgagcucccuggugcugguggucagccucggggccaucagcuucuggaugugcuccaacggcagccugcagugccggaucugcaucuga

SEQ ID NO: 68063 - RNA, 1701 nt, Artificial Sequence; identical to SEQ ID NO: 67443
  derived and/or modified sequence opt1 from hemagglutinin__InfluenzaA__AEL93628

SEQ ID NO: 68064 - RNA, 1701 nt, Artificial Sequence; identical to SEQ ID NO: 67878
  derived and/or modified sequence opt1 from hemagglutinin__InfluenzaA__AEL93638

SEQ ID NO: 68065 - RNA, 1701 nt, Artificial Sequence
  derived and/or modified sequence opt1 from hemagglutinin__InfluenzaA__AEL94870
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucaagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 68066 - RNA, 1701 nt, Artificial Sequence
  derived and/or modified sequence opt1 from hemagglutinin__InfluenzaA__AEL95426
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 68067 - RNA, 1701 nt, Artificial Sequence
  derived and/or modified sequence opt1 from hemagglutinin__InfluenzaA__AEL97631
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucaagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaccaccaucgggaagugccccaaguacgucaagagcaccaagcugcggcuggcgacgggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 68068 - RNA, 1701 nt, Artificial Sequence
  derived and/or modified sequence opt1 from hemagglutinin__InfluenzaA__AEL99664
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucaagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacguccguccacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 68069 - RNA, 1701 nt, Artificial Sequence
  derived and/or modified sequence opt1 from hemagglutinin__InfluenzaA__AEL99674
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaucuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68070 - RNA, 1689 nt, Artificial Sequence; identical to SEQ ID NO: 67279
  derived and/or modified sequence opt1 from hemagglutinin__InfluenzaA__AEM53455

SEQ ID NO: 68071 - RNA, 1689 nt, Artificial Sequence; identical to SEQ ID NO: 62628
  derived and/or modified sequence opt1 from hemagglutinin__InfluenzaA__AEM53468

SEQ ID NO: 68072 - RNA, 1698 nt, Artificial Sequence; identical to SEQ ID NO: 63123
  derived and/or modified sequence opt1 from hemagglutinin__InfluenzaA__AEM60037

SEQ ID NO: 68073 - RNA, 1698 nt, Artificial Sequence
  derived and/or modified sequence opt1 from hemagglutinin__InfluenzaA__AEM60058
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggagagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcgagagcuccuucuaccgcaaccugcuguggcucaccgggaagaacggccuguaccccaaccugagcaaguccuacgccaacaacaaggagaaggacgugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucgggcgcggcuucggcuccgggaucaucacgagcaacgcccccauggacaagugcgacgcgaagugccagacgccccagggcgccaucaacuccagccugcccuuccagaacguccacccggugaccaucggggagugccccaaguacgugcgguccaccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgcgagaagaucgacggcgugaagcuggagagcaugggggucuaccagauccuggcgaucuacuccaccguggccagcagccucgugcugcuggucucccucggcgccaucagcuucuggaugugcuccaacgggagccugcagugccggaucugcaucuga

SEQ ID NO: 68074 - RNA, 1701 nt, Artificial Sequence
  derived and/or modified sequence opt1 from hemagglutinin__InfluenzaA__AEM60069
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaaguccuucuucagccggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugagcaccaagcggagccagcagacggugaucccgaacaucgggucccgccccuggguccggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 68075 - RNA, 1701 nt, Artificial Sequence
  derived and/or modified sequence opt1 from hemagglutinin__InfluenzaA__AEM92308
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagcggaacagcuaccccaagcuguccaagagcuacaucaacgacaaggggaaggaggugcugguccucuggggcauccaccaccccagcaccuccgccgaccagcagagccuguaccagaacgccgacgccuacguguucgugggguccagccgcuacuccaagaaguucaagcccgagaucgccauccggccgaagguccgcgaccaggagggccggaugaacuacuacuggacgcugguggagcccggcgacaagaucaccuucgaggcgaccgagaaccucguggucccccgcuacgccuucgccauggagcggaacgccgggagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcgccucgcgaccggccugcggaacgucccgagcauccagucccgcgggcuguucggcgccaucgccggguucaucgagggcggguggaccggcaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggagccagcugaagaacaacgccaaggaggugggcaacggcugcuucgaguucuaccacaagugcgacaacacgugcauggaguccgugaagaacgggaccuacgacuaccccaaguacagcgaggaggccaagcugaaccgcgaggagaucgacggcgucaagcucgaguccacccggaucuaccagauccuggcgaucuacagcaccgccgccagcucccuggugcucguggucagccugggggccaucuccuucuggaugugcagcaacggcucccugcagugccgcaucugcaucuga

SEQ ID NO: 68076 - RNA, 1701 nt, Artificial Sequence
  derived and/or modified sequence opt1 from hemagglutinin__InfluenzaA__AEM92318
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgagaaguccuucuacaagaaccugaucuggcucgugaagaaggggaacagcuaccccaagcugaacaaguccuacaucaacgacaagggcaaggaggugcugguccucugggggauccaccaccccagcaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccauccacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgugccgagcauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 68077 - RNA, 1701 nt, Artificial Sequence
  derived and/or modified sequence opt1 from hemagglutinin__InfluenzaA__AEM92328
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaucuccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 68078 - RNA, 1701 nt, Artificial Sequence
  derived and/or modified sequence opt1 from hemagglutinin__InfluenzaA__AEM92348
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgagaaguccuucuacaagaaccugaucuggcucgugaagaaggggaacagcuaccccaagcugaacaaguccuacaucaacgacaagggcaaggaggugcugguccucugggggauccaccaccccagcaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccauccacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgugccgagcauccagucccgggggcuguucggcgcgaucgccggguucaucgagggcggcuggacggggauggucgacggcugguacggguaccaccaccagaacgagcagggcagcggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggucaagagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacagcaccguggcguccagccugguccucguggugagccugggggccaucuccuucuggaugugcagcaacggcucccugcagugccgcaucugcaucuga

SEQ ID NO: 68079 - RNA, 1701 nt, Artificial Sequence
  derived and/or modified sequence opt1 from hemagglutinin__InfluenzaA__AEM92358
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaaggaggggaacagcuaccccaagcuguccaagagcuacaucaacgacaagggcaaggaggugcugguccucugggggauccaccaccccagcaccacgaccgaccagcagucccuguaccagaacgccgacgccuacguguucgugggcaccagccgguacuccaagaaguucaagcccgagaucgccauccgcccgaagaugcgggaccaggagggccgcaugaacuacuacuggacccuggucgagcccggggacaagaucacguucgaggccaccggcaaccucguggugccccgguacgcguucgccauggagcgcaacgccgggagcggcaucaucaucuccgacacccccguccacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 68080 - RNA, 1701 nt, Artificial Sequence
  derived and/or modified sequence opt1 from hemagglutinin__InfluenzaA__AEM92368
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 68081 - RNA, 1701 nt, Artificial Sequence
  derived and/or modified sequence opt1 from hemagglutinin__InfluenzaA__AEM92378
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugaacagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugaacaagagcuacaucaacgacaagggcaaggaggugcugguccucugggggauccaccaccccuccaccacggccgaccagcagagccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucuccuucuggaugugcagcaacggcagccugcagugccggaucugcaucuga

SEQ ID NO: 68082 - RNA, 1701 nt, Artificial Sequence
  derived and/or modified sequence opt1 from hemagglutinin__InfluenzaA__AEM92407
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccaacuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccuccaccagcacggaccagcagagccuguaccagaacgccgacgccuacguguucgugggcaccucccgguacagcaagaaguucaagcccgagaucgccauccgcccgaagguccggaaccaggagggccgcaugaacuacuacuggacccugguggagcccggggacaagaucaccuucgaggccacgggcaaccucguggucccccgguacgcguucaccaucgagcgcaacgccggguccggcaucaucaucagcgacacccccauccacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggacccacaacgcggagcugcugguccuccuggagaacgagcggacgcuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggccagcucccugguccucguggugagccugggggcgaucagcuucuggaugugcuccaugggcagccugcagugccggaucugcaucuga

SEQ ID NO: 68083 - RNA, 1701 nt, Artificial Sequence
  derived and/or modified sequence opt1 from hemagglutinin__InfluenzaA__AEM92417
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcuggugaagaaggagaacagcuaccccaagcucuccaagagcuacaucaacgacaaggggaaggaggugcugguccuguggggcauccaccaccccagcaccuccgccgaccagcagagccucuaccagaacgccgacgccuacguguucgugggguccagccgguacuccaagaaguucaagcccgagaucgcgauccgcccgaagguccgggaccaggagggccgcaugaacuacuacuggacccugguggagcccggcgacaagaucacguucgaggccaccgggaaccugguggucccccgguacgccuucgccauggagcgcaacgccggcagcgggaucaucaucuccgacacccccgugcacgacugcaacaccacgugccagaccccgaagggcgcgaucaacaccagccuccccuuccagaacauccaccccaucaccaucggcaagugccccaaguacgugaaguccacgaagcugcggcuggccaccgggcuccgcaacgucccgagcauccagucccggggccuguucggggccaucgccggcuucaucgagggcggguggaccggcaugguggacgggugguacggcuaccaccaccagaacgagcaggggagcggcuacgccgcggaccugaaguccacccagaacgccaucgacgagaucacgaacaaggugaacagcgucaucgagaagaugaacacccaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacagcgaggaggcgaagcugaaccgggaggagaucgacggggugaagcuggaguccacccgcaucuaccagauccucgccaucuacagcaccgucgccagcucccuggugcugguggucagccucggcgccaucuccuucuggaugugcagcaacgggucccugcagugccggaucugcaucuga

SEQ ID NO: 68084 - RNA, 1701 nt, Artificial Sequence
  derived and/or modified sequence opt1 from hemagglutinin__InfluenzaA__AEM92428
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacaugugcauggagagcgugaagaacgggaccuacgacuaccccaaguacuccgaggaggccaagcugaaccgggaggagaucgacggcgugaagcucgagagcacgcgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68085 - RNA, 1701 nt, Artificial Sequence
  derived and/or modified sequence opt1 from hemagglutinin__InfluenzaA__AEM92438
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagauccgcaaccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggccaucuacagcaccguggcguccagccugguccucguggugucccugggcgccaucagcuucuggaugugcagcaacggcucccugcagugccggaucugcaucuga

SEQ ID NO: 68086 - RNA, 1701 nt, Artificial Sequence; identical to SEQ ID NO: 67817
  derived and/or modified sequence opt1 from hemagglutinin__InfluenzaA__AEM92448

SEQ ID NO: 68087 - RNA, 1701 nt, Artificial Sequence; identical to SEQ ID NO: 67817
  derived and/or modified sequence opt1 from hemagglutinin__InfluenzaA__AEM92458

SEQ ID NO: 68088 - RNA, 1701 nt, Artificial Sequence
  derived and/or modified sequence opt1 from hemagglutinin__InfluenzaA__AEM92468
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaaggaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacaccaucugccagaccccgaagggcgccaucaacaccucccugcccuuccagaacauccaccccaucacgaucgggaagugccccaaguacgucaagagcaccaagcuccgccuggcgaccggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccucaacaagaaggucgacgacggcuuccuggacaucuggacguacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 68089 - RNA, 1701 nt, Artificial Sequence
  derived and/or modified sequence opt1 from hemagglutinin__InfluenzaA__AEM92478
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacaccaucugccagaccccgaagggcgccaucaacaccucccugcccuuccagaacauccaccccaucacgaucgggaagugccccaaguacgucaagagcaccaagcuccgccuggcgaccggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccucaacaagaaggucgacgacggcuuccuggacaucuggacguacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 68090 - RNA, 1701 nt, Artificial Sequence
  derived and/or modified sequence opt1 from hemagglutinin__InfluenzaA__AEM92498
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccaacuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccuccaccagcgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcucccugguccucguggugagccugggggccaucagcuucuggaugugcuccaacggcagccugcagugccggaucugcaucuga

SEQ ID NO: 68091 - RNA, 1701 nt, Artificial Sequence
  derived and/or modified sequence opt1 from hemagglutinin__InfluenzaA__AEM92518
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagcggaaggaggugcugguccucuggggcauccaccacccgcccacgagcgcggaccagcagucccuguaccagaacgccgacgccuacguguucguggggaccagccgcuacuccaagaaguucaagcccgagaucgccauccggcccaagguccgcgaccaggagggccggaugaacuacuacuggacccugguggagcccggcgacaagaucaccuucgaggccacggggaaccucguggucccccgcuacgcguucgccauggagcggaacgccggcagcgggaucaucaucuccgacaccccggugcacgacugcaacgcgaccugccagacccccaagggcgccaucaacacgagccugcccuuccagaacauccaccccaucaccaucggcaagugcccgaaguacgugaaguccaccaagcugcgccucgccaccgggcugcggaacguccccagcauccagucccgcggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaaggugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccuccagccuggugcucguggucagccugggcgccaucuccuucuggaugugcagcaacgggucccugcagugccgcaucugcaucuga

SEQ ID NO: 68092 - RNA, 1701 nt, Artificial Sequence
  derived and/or modified sequence opt1 from hemagglutinin__InfluenzaA__AEM92528
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggccuucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcucccuggugcucguggucagccugggggccaucagcuucuggaugugcuccaacggcagccugcagugccggaucugcaucuga

SEQ ID NO: 68093 - RNA, 1701 nt, Artificial Sequence
  derived and/or modified sequence opt1 from hemagglutinin__InfluenzaA__AEM92548
augaaggccauccuggugguccuccuguacaccuucgccaccgcgacggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68094 - RNA, 1701 nt, Artificial Sequence
  derived and/or modified sequence opt1 from hemagglutinin__InfluenzaA__AEM92558
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcagcaucgccggcuggauccuggggaacccggagugcgagucccugagcaccgcguccagcugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68095 - RNA, 1701 nt, Artificial Sequence; identical to SEQ ID NO: 68094
  derived and/or modified sequence opt1 from hemagglutinin__InfluenzaA__AEM92568

SEQ ID NO: 68096 - RNA, 1701 nt, Artificial Sequence
  derived and/or modified sequence opt1 from hemagglutinin__InfluenzaA__AEM92578
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaucagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 68097 - RNA, 1701 nt, Artificial Sequence
  derived and/or modified sequence opt1 from hemagglutinin__InfluenzaA__AEM92608
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 68098 - RNA, 1701 nt, Artificial Sequence
  derived and/or modified sequence opt1 from hemagglutinin__InfluenzaA__AEM92618
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccaacuccuggcccaaccacgacagcaacaagggggucaccgccgccugcccgcacgccggcgcgaaguccuucuacaagaaccugaucuggcucgugaagaccgggaacagcuaccccaagcuguccaagagcuacaucaacgacaagggcaaggaggugcugguccucugggggauccaccaccccuccacgagcgccgaccagcagagccuguaccagaacgccgacgccuacguguucgugggcaccucccgguacagccgcaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccggguccggcaucaucaucagcgacacccccgcccacgacugcaacacgaccugccagaccccgaagggcgcgaucaacaccucccugcccuuccagaacauccaccccaucaccaucgggaagugccccaaguacgucaagagcaccaagcugcgccucgccacgggccugcggaacgugccguccauccagagccgcgggcuguucggcgccaucgccggguucaucgagggcggcuggaccgggaugguggacggcugguacggguaccaccaccagaacgagcagggcuccggguacgccgcggaccucaagagcacccagaacgccaucgacaagaucaccaacaaggugaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgcgaggagaucgacggcgugaagcucgagagcacccggaucuaccagauccuggccaucuacuccaccguggccagcucccugguccucguggugagccugggggccaucagcuucuggaugugcuccaacggcagccugcagugccgcaucugcaucuga

SEQ ID NO: 68099 - RNA, 1701 nt, Artificial Sequence
  derived and/or modified sequence opt1 from hemagglutinin__InfluenzaA__AEM92638
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgcgagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacaccaacaagggggucaccgccgccugcccgcacgccggcgccaagagcuucuacaagaaccugaucuggcuggugaagaaggggaacuccuaccccaagcucagcaaguccuacaucaacgacaagggcaaggaggugcugguccugugggggauccaccaccccagcacgagcgccgaccagcagucccucuaccagaacgccgacgccuacguguucgugggcagcucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagaagaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagguggggaacggcugcuucgaguucuaccacaagugcgacaacacgugcauggagagcgugaagaacgggaccuacgacuaccccaaguacuccgaggaggccaagcugaaccgcgaggagaucgacggcgucaagcuggagagcacccggaucuaccagauccucgcgaucuacuccaccgccgccagcagccuggugcugguggucucccucggggccaucagcuucuggaugugcuccaacggcagccugcagugccgcaucugcaucuga

SEQ ID NO: 68100 - RNA, 1701 nt, Artificial Sequence
  derived and/or modified sequence opt1 from hemagglutinin__InfluenzaA__AEM92648
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgcgagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacaccaacaagggggucaccgccgccugcccgcacgccggcgccaagagcuucuacaagaaccugaucuggcuggugaaggaggggaacuccuaccccaagcucagcaaguccuacaucaacgacaagggcaaggaggugcugguccugugggggauccaccaccccagcacgagcgccgaccagcagucccucuaccagaacgccgacgccuacguguucgugggcagcucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagaagaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagguggggaacggcugcuucgaguucuaccacaagugcgacaacacgugcauggagagcgugaagaacgggaccuacgacuaccccaaguacuccgaggaggccaagcugaaccgcgaggagaucgacggcgucaagcuggagagcacccggaucuaccagauccucgcgaucuacuccaccgccgccagcagccuggugcugguggucucccucggggccaucagcuucuggaugugcuccaacggcagccugcagugccgcaucugcaucuga

SEQ ID NO: 68101 - RNA, 1701 nt, Artificial Sequence; identical to SEQ ID NO: 66541
  derived and/or modified sequence opt1 from hemagglutinin__InfluenzaA__AEM98407

SEQ ID NO: 68102 - RNA, 1701 nt, Artificial Sequence; identical to SEQ ID NO: 66541
  derived and/or modified sequence opt1 from hemagglutinin__InfluenzaA__AEM98418

SEQ ID NO: 68103 - RNA, 1701 nt, Artificial Sequence; identical to SEQ ID NO: 66541
  derived and/or modified sequence opt1 from hemagglutinin__InfluenzaA__AEM98429

SEQ ID NO: 68104 - RNA, 1701 nt, Artificial Sequence
  derived and/or modified sequence opt1 from hemagglutinin__InfluenzaA__AEN55398
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgugaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68105 - RNA, 1701 nt, Artificial Sequence; identical to SEQ ID NO: 67928
  derived and/or modified sequence opt1 from hemagglutinin__InfluenzaA__AEN55408

SEQ ID NO: 68106 - RNA, 1701 nt, Artificial Sequence; identical to SEQ ID NO: 67443
  derived and/or modified sequence opt1 from hemagglutinin__InfluenzaA__AEN55418

SEQ ID NO: 68107 - RNA, 1701 nt, Artificial Sequence; identical to SEQ ID NO: 66592
  derived and/or modified sequence opt1 from hemagglutinin__InfluenzaA__AEN55463

SEQ ID NO: 68108 - RNA, 1701 nt, Artificial Sequence
  derived and/or modified sequence opt1 from hemagglutinin__InfluenzaA__AEN55473
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacgaccgaccagcagucccuguaccagaccgccgacaccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgccuucgcgauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgccaucgcgggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 68109 - RNA, 1701 nt, Artificial Sequence; identical to SEQ ID NO: 67443
  derived and/or modified sequence opt1 from hemagglutinin__InfluenzaA__AEN55483

SEQ ID NO: 68110 - RNA, 1701 nt, Artificial Sequence; identical to SEQ ID NO: 68050
  derived and/or modified sequence opt1 from hemagglutinin__InfluenzaA__AEN55493

SEQ ID NO: 68111 - RNA, 1701 nt, Artificial Sequence; identical to SEQ ID NO: 67443
  derived and/or modified sequence opt1 from hemagglutinin__InfluenzaA__AEN55503

SEQ ID NO: 68112 - RNA, 1701 nt, Artificial Sequence
  derived and/or modified sequence opt1 from hemagglutinin__InfluenzaA__AEN55513
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagaaccuguaccagaacgccgacaccuacguguucgugggcaccucccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 68113 - RNA, 1701 nt, Artificial Sequence; identical to SEQ ID NO: 67443
  derived and/or modified sequence opt1 from hemagglutinin__InfluenzaA__AEN55523

SEQ ID NO: 68114 - RNA, 1701 nt, Artificial Sequence; identical to SEQ ID NO: 66232
  derived and/or modified sequence opt1 from hemagglutinin__InfluenzaA__AEN68904

SEQ ID NO: 68115 - RNA, 1701 nt, Artificial Sequence; identical to SEQ ID NO: 63677
  derived and/or modified sequence opt1 from hemagglutinin__InfluenzaA__AEN68905

SEQ ID NO: 68116 - RNA, 1701 nt, Artificial Sequence; identical to SEQ ID NO: 63677
  derived and/or modified sequence opt1 from hemagglutinin__InfluenzaA__AEN68906

SEQ ID NO: 68117 - RNA, 1701 nt, Artificial Sequence; identical to SEQ ID NO: 64779
  derived and/or modified sequence opt1 from hemagglutinin__InfluenzaA__AEN68907

SEQ ID NO: 68118 - RNA, 1701 nt, Artificial Sequence; identical to SEQ ID NO: 63677
  derived and/or modified sequence opt1 from hemagglutinin__InfluenzaA__AEN68908

SEQ ID NO: 68119 - RNA, 1701 nt, Artificial Sequence
  derived and/or modified sequence opt1 from hemagglutinin__InfluenzaA__AEN68909
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 68120 - RNA, 1701 nt, Artificial Sequence
  derived and/or modified sequence opt1 from hemagglutinin__InfluenzaA__AEN68910
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagggcaccaagcugcggcucgcgaccgggcugcgcaacgugccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggucaagcucgaguccacccgcaucuaccagauccuggcgaucuacagcaccguggccuccagccuggugcucgucgugagccugggcgccaucuccuucuggaugugcagcaacggcucccugcagugccggaucugcaucuga

SEQ ID NO: 68121 - RNA, 1701 nt, Artificial Sequence; identical to SEQ ID NO: 65793
  derived and/or modified sequence opt1 from hemagglutinin__InfluenzaA__AEN68911

SEQ ID NO: 68122 - RNA, 1701 nt, Artificial Sequence; identical to SEQ ID NO: 63677
  derived and/or modified sequence opt1 from hemagglutinin__InfluenzaA__AEN68912

SEQ ID NO: 68123 - RNA, 1701 nt, Artificial Sequence; identical to SEQ ID NO: 63768
  derived and/or modified sequence opt1 from hemagglutinin__InfluenzaA__AEN68913

SEQ ID NO: 68124 - RNA, 1701 nt, Artificial Sequence; identical to SEQ ID NO: 66343
  derived and/or modified sequence opt1 from hemagglutinin__InfluenzaA__AEN68914

SEQ ID NO: 68125 - RNA, 1701 nt, Artificial Sequence; identical to SEQ ID NO: 63677
  derived and/or modified sequence opt1 from hemagglutinin__InfluenzaA__AEN68915

SEQ ID NO: 68126 - RNA, 1701 nt, Artificial Sequence; identical to SEQ ID NO: 63677
  derived and/or modified sequence opt1 from hemagglutinin__InfluenzaA__AEN68916

SEQ ID NO: 68127 - RNA, 1701 nt, Artificial Sequence
  derived and/or modified sequence opt1 from hemagglutinin__InfluenzaA__AEN68917
augaaggccauccugggcgugcuccuguacaccuucgccaccgcgaacgccgacacgcugugcaucggguaccacgccaacaacagcaccgacaccgucgacaccgugcucgagaagaacgugacggucacccacuccgugaaccugcuggaggacaagcacaacggcaagcucugcaagcugcgcgggguggcgccccugcaccucggcaagugcaacaucgccggguggauccugggcaacccggagugcgagagccuguccaccgccagcuccuggagcuacaucgucgagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgugaccgccgccugcccgcacgccggggcgaaguccuucuacaagaaccugaucuggcucgucaagaagggcaacagcuaccccaagcuguccaagagcuacaucaacgacaaggggaaggaggugcuggugcucuggggcauccaccaccccagcaccuccgccgaccagcagagccuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccgugaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 68128 - RNA, 1701 nt, Artificial Sequence
  derived and/or modified sequence opt1 from hemagglutinin__InfluenzaA__AEN68918
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagaacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagguggggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 68129 - RNA, 1701 nt, Artificial Sequence; identical to SEQ ID NO: 66592
  derived and/or modified sequence opt1 from hemagglutinin__InfluenzaA__AEN68919

SEQ ID NO: 68130 - RNA, 1701 nt, Artificial Sequence; identical to SEQ ID NO: 65841
  derived and/or modified sequence opt1 from hemagglutinin__InfluenzaA__AEN68920

SEQ ID NO: 68131 - RNA, 1701 nt, Artificial Sequence; identical to SEQ ID NO: 64841
  derived and/or modified sequence opt1 from hemagglutinin__InfluenzaA__AEN68921

SEQ ID NO: 68132 - RNA, 1701 nt, Artificial Sequence; identical to SEQ ID NO: 64837
  derived and/or modified sequence opt1 from hemagglutinin__InfluenzaA__AEN68922

SEQ ID NO: 68133 - RNA, 1701 nt, Artificial Sequence; identical to SEQ ID NO: 64841
  derived and/or modified sequence opt1 from hemagglutinin__InfluenzaA__AEN68923

SEQ ID NO: 68134 - RNA, 1701 nt, Artificial Sequence; identical to SEQ ID NO: 64841
  derived and/or modified sequence opt1 from hemagglutinin__InfluenzaA__AEN68924

SEQ ID NO: 68135 - RNA, 1701 nt, Artificial Sequence
  derived and/or modified sequence opt1 from hemagglutinin__InfluenzaA__AEN68925
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucguggagacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 68136 - RNA, 1701 nt, Artificial Sequence
  derived and/or modified sequence opt1 from hemagglutinin__InfluenzaA__AEN68926
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuggccaccgccuccagcugguccuacaucguggagaccagcaacuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgcgggcgccaaguccuucuacaagaaccugaucuggcucgugaagaaggggaacagcuaccccaagcuguccaagagcuacaucaacgacaagggccgggaggugcugguccucugggggauccaccaccccuccaccagcgccgaccagcagagccuguaccagaacgccgacacguacguguucgugggcaccucccgcuacagcaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 68137 - RNA, 1701 nt, Artificial Sequence
  derived and/or modified sequence opt1 from hemagglutinin__InfluenzaA__AEN68927
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68138 - RNA, 1701 nt, Artificial Sequence; identical to SEQ ID NO: 67263
  derived and/or modified sequence opt1 from hemagglutinin__InfluenzaA__AEN68928

SEQ ID NO: 68139 - RNA, 1701 nt, Artificial Sequence
  derived and/or modified sequence opt1 from hemagglutinin__InfluenzaA__AEN68929
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 68140 - RNA, 1701 nt, Artificial Sequence; identical to SEQ ID NO: 66592
  derived and/or modified sequence opt1 from hemagglutinin__InfluenzaA__AEN68930

SEQ ID NO: 68141 - RNA, 1701 nt, Artificial Sequence; identical to SEQ ID NO: 66592
  derived and/or modified sequence opt1 from hemagglutinin__InfluenzaA__AEN68931

SEQ ID NO: 68142 - RNA, 1701 nt, Artificial Sequence; identical to SEQ ID NO: 66592
  derived and/or modified sequence opt1 from hemagglutinin__InfluenzaA__AEN68932

SEQ ID NO: 68143 - RNA, 1701 nt, Artificial Sequence
  derived and/or modified sequence opt1 from hemagglutinin__InfluenzaA__AEN69426
augaaggccauccuggugguccuccuguacaccuucgccaccagcaacgcggacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcaacuucaucgacuacgaggagcuccgggagcagcuguccagcguguccagcuucgagcgcuucgagaucuuccccaagaccuccagcuggcccgaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggcgccccgguacgccuucgccauggagcgcaacgccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgugccgagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 68144 - RNA, 1701 nt, Artificial Sequence; identical to SEQ ID NO: 67928
  derived and/or modified sequence opt1 from hemagglutinin__InfluenzaA__AEN69475

SEQ ID NO: 68145 - RNA, 1701 nt, Artificial Sequence; identical to SEQ ID NO: 67928
  derived and/or modified sequence opt1 from hemagglutinin__InfluenzaA__AEN69481

SEQ ID NO: 68146 - RNA, 1701 nt, Artificial Sequence; identical to SEQ ID NO: 63930
  derived and/or modified sequence opt1 from hemagglutinin__InfluenzaA__AEO01032

SEQ ID NO: 68147 - RNA, 1701 nt, Artificial Sequence; identical to SEQ ID NO: 64030
  derived and/or modified sequence opt1 from hemagglutinin__InfluenzaA__AEO01033

SEQ ID NO: 68148 - RNA, 1701 nt, Artificial Sequence; identical to SEQ ID NO: 64030
  derived and/or modified sequence opt1 from hemagglutinin__InfluenzaA__AEO01034

SEQ ID NO: 68149 - RNA, 1701 nt, Artificial Sequence; identical to SEQ ID NO: 63664
  derived and/or modified sequence opt1 from hemagglutinin__InfluenzaA__AEO01035

SEQ ID NO: 68150 - RNA, 1701 nt, Artificial Sequence; identical to SEQ ID NO: 64030
  derived and/or modified sequence opt1 from hemagglutinin__InfluenzaA__AEO01036

SEQ ID NO: 68151 - RNA, 1701 nt, Artificial Sequence; identical to SEQ ID NO: 63919
  derived and/or modified sequence opt1 from hemagglutinin__InfluenzaA__AEO01037

SEQ ID NO: 68152 - RNA, 1701 nt, Artificial Sequence; identical to SEQ ID NO: 64030
  derived and/or modified sequence opt1 from hemagglutinin__InfluenzaA__AEO01038

SEQ ID NO: 68153 - RNA, 1701 nt, Artificial Sequence; identical to SEQ ID NO: 63857
  derived and/or modified sequence opt1 from hemagglutinin__InfluenzaA__AEO01039

SEQ ID NO: 68154 - RNA, 1701 nt, Artificial Sequence
  derived and/or modified sequence opt1 from hemagglutinin__InfluenzaA__AEO01040
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaagaaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucacgauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 68155 - RNA, 1701 nt, Artificial Sequence; identical to SEQ ID NO: 63677
  derived and/or modified sequence opt1 from hemagglutinin__InfluenzaA__AEO01041

SEQ ID NO: 68156 - RNA, 1701 nt, Artificial Sequence; identical to SEQ ID NO: 64030
  derived and/or modified sequence opt1 from hemagglutinin__InfluenzaA__AEO01042

SEQ ID NO: 68157 - RNA, 1701 nt, Artificial Sequence
  derived and/or modified sequence opt1 from hemagglutinin__InfluenzaA__AEO01043
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccaacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68158 - RNA, 1701 nt, Artificial Sequence; identical to SEQ ID NO: 63677
  derived and/or modified sequence opt1 from hemagglutinin__InfluenzaA__AEO01044

SEQ ID NO: 68159 - RNA, 1701 nt, Artificial Sequence
  derived and/or modified sequence opt1 from hemagglutinin__InfluenzaA__AEO01045
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaaccuggagugcgagagccucuccaccgccagcuccuggagcuacaucguggagaccuccagcuccgacaacggcacgugcuacccgggcgacuucaucgacuacgaggagcugcgggagcagcugagcuccgugagcuccuucgagcgcuucgagaucuuccccaagaccagcuccuggcccaaccacgacagcaacaagggggucaccgccgccugcccccacgccggcgcgaaguccuucuacaagaaccucaucuggcuggugaagaaggggaacagcuacccgaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 68160 - RNA, 1701 nt, Artificial Sequence; identical to SEQ ID NO: 63677
  derived and/or modified sequence opt1 from hemagglutinin__InfluenzaA__AEO01046

SEQ ID NO: 68161 - RNA, 1701 nt, Artificial Sequence; identical to SEQ ID NO: 63677
  derived and/or modified sequence opt1 from hemagglutinin__InfluenzaA__AEO01047

SEQ ID NO: 68162 - RNA, 1701 nt, Artificial Sequence
  derived and/or modified sequence opt1 from hemagglutinin__InfluenzaA__AEO01048
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugcaagaucugcaucuga

SEQ ID NO: 68163 - RNA, 1701 nt, Artificial Sequence; identical to SEQ ID NO: 64575
  derived and/or modified sequence opt1 from hemagglutinin__InfluenzaA__AEO01049

SEQ ID NO: 68164 - RNA, 1701 nt, Artificial Sequence; identical to SEQ ID NO: 63677
  derived and/or modified sequence opt1 from hemagglutinin__InfluenzaA__AEO01050

SEQ ID NO: 68165 - RNA, 1701 nt, Artificial Sequence; identical to SEQ ID NO: 64030
  derived and/or modified sequence opt1 from hemagglutinin__InfluenzaA__AEO01051

SEQ ID NO: 68166 - RNA, 1701 nt, Artificial Sequence
  derived and/or modified sequence opt1 from hemagglutinin__InfluenzaA__AEO01052
augaaggccaucaucgugguccugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 68167 - RNA, 1701 nt, Artificial Sequence; identical to SEQ ID NO: 64030
  derived and/or modified sequence opt1 from hemagglutinin__InfluenzaA__AEO01053

SEQ ID NO: 68168 - RNA, 1701 nt, Artificial Sequence; identical to SEQ ID NO: 63677
  derived and/or modified sequence opt1 from hemagglutinin__InfluenzaA__AEO01054

SEQ ID NO: 68169 - RNA, 1701 nt, Artificial Sequence; identical to SEQ ID NO: 64489
  derived and/or modified sequence opt1 from hemagglutinin__InfluenzaA__AEO01055

SEQ ID NO: 68170 - RNA, 1701 nt, Artificial Sequence; identical to SEQ ID NO: 64030
  derived and/or modified sequence opt1 from hemagglutinin__InfluenzaA__AEO01056

SEQ ID NO: 68171 - RNA, 1701 nt, Artificial Sequence; identical to SEQ ID NO: 63677
  derived and/or modified sequence opt1 from hemagglutinin__InfluenzaA__AEO01057

SEQ ID NO: 68172 - RNA, 1701 nt, Artificial Sequence; identical to SEQ ID NO: 63677
  derived and/or modified sequence opt1 from hemagglutinin__InfluenzaA__AEO01058

SEQ ID NO: 68173 - RNA, 1701 nt, Artificial Sequence; identical to SEQ ID NO: 63677
  derived and/or modified sequence opt1 from hemagglutinin__InfluenzaA__AEO01059

SEQ ID NO: 68174 - RNA, 1701 nt, Artificial Sequence; identical to SEQ ID NO: 63677
  derived and/or modified sequence opt1 from hemagglutinin__InfluenzaA__AEO01060

SEQ ID NO: 68175 - RNA, 1701 nt, Artificial Sequence; identical to SEQ ID NO: 63677
  derived and/or modified sequence opt1 from hemagglutinin__InfluenzaA__AEO01061

SEQ ID NO: 68176 - RNA, 1701 nt, Artificial Sequence; identical to SEQ ID NO: 63677
  derived and/or modified sequence opt1 from hemagglutinin__InfluenzaA__AEO01062

SEQ ID NO: 68177 - RNA, 1701 nt, Artificial Sequence; identical to SEQ ID NO: 63677
  derived and/or modified sequence opt1 from hemagglutinin__InfluenzaA__AEO01063

SEQ ID NO: 68178 - RNA, 1701 nt, Artificial Sequence; identical to SEQ ID NO: 63677
  derived and/or modified sequence opt1 from hemagglutinin__InfluenzaA__AEO01064

SEQ ID NO: 68179 - RNA, 1701 nt, Artificial Sequence; identical to SEQ ID NO: 63919
  derived and/or modified sequence opt1 from hemagglutinin__InfluenzaA__AEO01065

SEQ ID NO: 68180 - RNA, 1701 nt, Artificial Sequence; identical to SEQ ID NO: 64030
  derived and/or modified sequence opt1 from hemagglutinin__InfluenzaA__AEO01066

SEQ ID NO: 68181 - RNA, 1701 nt, Artificial Sequence
  derived and/or modified sequence opt1 from hemagglutinin__InfluenzaA__AEO01067
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagauggccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68182 - RNA, 1701 nt, Artificial Sequence; identical to SEQ ID NO: 64030
  derived and/or modified sequence opt1 from hemagglutinin__InfluenzaA__AEO01068

SEQ ID NO: 68183 - RNA, 1701 nt, Artificial Sequence; identical to SEQ ID NO: 63677
  derived and/or modified sequence opt1 from hemagglutinin__InfluenzaA__AEO01069

SEQ ID NO: 68184 - RNA, 1701 nt, Artificial Sequence; identical to SEQ ID NO: 64030
  derived and/or modified sequence opt1 from hemagglutinin__InfluenzaA__AEO01070

SEQ ID NO: 68185 - RNA, 1701 nt, Artificial Sequence; identical to SEQ ID NO: 63677
  derived and/or modified sequence opt1 from hemagglutinin__InfluenzaA__AEO01071

SEQ ID NO: 68186 - RNA, 1701 nt, Artificial Sequence
  derived and/or modified sequence opt1 from hemagglutinin__InfluenzaA__AEO01073
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccgugaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 68187 - RNA, 1701 nt, Artificial Sequence; identical to SEQ ID NO: 63919
  derived and/or modified sequence opt1 from hemagglutinin__InfluenzaA__AEO01074

SEQ ID NO: 68188 - RNA, 1701 nt, Artificial Sequence; identical to SEQ ID NO: 64030
  derived and/or modified sequence opt1 from hemagglutinin__InfluenzaA__AEO01075

SEQ ID NO: 68189 - RNA, 1701 nt, Artificial Sequence; identical to SEQ ID NO: 64030
  derived and/or modified sequence opt1 from hemagglutinin__InfluenzaA__AEO01076

SEQ ID NO: 68190 - RNA, 1701 nt, Artificial Sequence
  derived and/or modified sequence opt1 from hemagglutinin__InfluenzaA__AEO01077
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagaacgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68191 - RNA, 1701 nt, Artificial Sequence; identical to SEQ ID NO: 63677
  derived and/or modified sequence opt1 from hemagglutinin__InfluenzaA__AEO01078

SEQ ID NO: 68192 - RNA, 1701 nt, Artificial Sequence; identical to SEQ ID NO: 63677
  derived and/or modified sequence opt1 from hemagglutinin__InfluenzaA__AEO01079

SEQ ID NO: 68193 - RNA, 1701 nt, Artificial Sequence; identical to SEQ ID NO: 63677
  derived and/or modified sequence opt1 from hemagglutinin__InfluenzaA__AEO01080

SEQ ID NO: 68194 - RNA, 1701 nt, Artificial Sequence; identical to SEQ ID NO: 64030
  derived and/or modified sequence opt1 from hemagglutinin__InfluenzaA__AEO01081

SEQ ID NO: 68195 - RNA, 1701 nt, Artificial Sequence; identical to SEQ ID NO: 63677
  derived and/or modified sequence opt1 from hemagglutinin__InfluenzaA__AEO01082

SEQ ID NO: 68196 - RNA, 1701 nt, Artificial Sequence; identical to SEQ ID NO: 63677
  derived and/or modified sequence opt1 from hemagglutinin__InfluenzaA__AEO01083

SEQ ID NO: 68197 - RNA, 1701 nt, Artificial Sequence; identical to SEQ ID NO: 63677
  derived and/or modified sequence opt1 from hemagglutinin__InfluenzaA__AEO01084

SEQ ID NO: 68198 - RNA, 1701 nt, Artificial Sequence; identical to SEQ ID NO: 64030
  derived and/or modified sequence opt1 from hemagglutinin__InfluenzaA__AEO01085

SEQ ID NO: 68199 - RNA, 1701 nt, Artificial Sequence; identical to SEQ ID NO: 63677
  derived and/or modified sequence opt1 from hemagglutinin__InfluenzaA__AEO01086

SEQ ID NO: 68200 - RNA, 1701 nt, Artificial Sequence; identical to SEQ ID NO: 64030
  derived and/or modified sequence opt1 from hemagglutinin__InfluenzaA__AEO01087

SEQ ID NO: 68201 - RNA, 1701 nt, Artificial Sequence; identical to SEQ ID NO: 63857
  derived and/or modified sequence opt1 from hemagglutinin__InfluenzaA__AEO01088

SEQ ID NO: 68202 - RNA, 1701 nt, Artificial Sequence; identical to SEQ ID NO: 64030
  derived and/or modified sequence opt1 from hemagglutinin__InfluenzaA__AEO01089

SEQ ID NO: 68203 - RNA, 1701 nt, Artificial Sequence; identical to SEQ ID NO: 64030
  derived and/or modified sequence opt1 from hemagglutinin__InfluenzaA__AEO01090

SEQ ID NO: 68204 - RNA, 1701 nt, Artificial Sequence; identical to SEQ ID NO: 64030
  derived and/or modified sequence opt1 from hemagglutinin__InfluenzaA__AEO01091

SEQ ID NO: 68205 - RNA, 1701 nt, Artificial Sequence
  derived and/or modified sequence opt1 from hemagglutinin__InfluenzaA__AEO01092
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagcgcguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68206 - RNA, 1701 nt, Artificial Sequence; identical to SEQ ID NO: 63677
  derived and/or modified sequence opt1 from hemagglutinin__InfluenzaA__AEO01093

SEQ ID NO: 68207 - RNA, 1701 nt, Artificial Sequence; identical to SEQ ID NO: 63677
  derived and/or modified sequence opt1 from hemagglutinin__InfluenzaA__AEO01094

SEQ ID NO: 68208 - RNA, 1701 nt, Artificial Sequence; identical to SEQ ID NO: 66884
  derived and/or modified sequence opt1 from hemagglutinin__InfluenzaA__AEO01095

SEQ ID NO: 68209 - RNA, 1701 nt, Artificial Sequence; identical to SEQ ID NO: 64030
  derived and/or modified sequence opt1 from hemagglutinin__InfluenzaA__AEO01096

SEQ ID NO: 68210 - RNA, 1701 nt, Artificial Sequence; identical to SEQ ID NO: 64030
  derived and/or modified sequence opt1 from hemagglutinin__InfluenzaA__AEO01097

SEQ ID NO: 68211 - RNA, 1701 nt, Artificial Sequence; identical to SEQ ID NO: 64030
  derived and/or modified sequence opt1 from hemagglutinin__InfluenzaA__AEO01098

SEQ ID NO: 68212 - RNA, 1701 nt, Artificial Sequence; identical to SEQ ID NO: 63677
  derived and/or modified sequence opt1 from hemagglutinin__InfluenzaA__AEO01099

SEQ ID NO: 68213 - RNA, 1701 nt, Artificial Sequence; identical to SEQ ID NO: 63919
  derived and/or modified sequence opt1 from hemagglutinin__InfluenzaA__AEO01100

SEQ ID NO: 68214 - RNA, 1701 nt, Artificial Sequence; identical to SEQ ID NO: 63677
  derived and/or modified sequence opt1 from hemagglutinin__InfluenzaA__AEO01101

SEQ ID NO: 68215 - RNA, 1701 nt, Artificial Sequence; identical to SEQ ID NO: 63677
  derived and/or modified sequence opt1 from hemagglutinin__InfluenzaA__AEO01102

SEQ ID NO: 68216 - RNA, 1701 nt, Artificial Sequence; identical to SEQ ID NO: 64030
  derived and/or modified sequence opt1 from hemagglutinin__InfluenzaA__AEO01103

SEQ ID NO: 68217 - RNA, 1701 nt, Artificial Sequence; identical to SEQ ID NO: 64030
  derived and/or modified sequence opt1 from hemagglutinin__InfluenzaA__AEO01104

SEQ ID NO: 68218 - RNA, 1701 nt, Artificial Sequence
  derived and/or modified sequence opt1 from hemagglutinin__InfluenzaA__AEO01105
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcuccaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68219 - RNA, 1701 nt, Artificial Sequence; identical to SEQ ID NO: 64030
  derived and/or modified sequence opt1 from hemagglutinin__InfluenzaA__AEO01106

SEQ ID NO: 68220 - RNA, 1701 nt, Artificial Sequence; identical to SEQ ID NO: 63677
  derived and/or modified sequence opt1 from hemagglutinin__InfluenzaA__AEO01107

SEQ ID NO: 68221 - RNA, 1701 nt, Artificial Sequence; identical to SEQ ID NO: 63677
  derived and/or modified sequence opt1 from hemagglutinin__InfluenzaA__AEO01108

SEQ ID NO: 68222 - RNA, 1701 nt, Artificial Sequence; identical to SEQ ID NO: 63677
  derived and/or modified sequence opt1 from hemagglutinin__InfluenzaA__AEO01109

SEQ ID NO: 68223 - RNA, 1701 nt, Artificial Sequence; identical to SEQ ID NO: 63677
  derived and/or modified sequence opt1 from hemagglutinin__InfluenzaA__AEO01110

SEQ ID NO: 68224 - RNA, 1701 nt, Artificial Sequence; identical to SEQ ID NO: 63677
  derived and/or modified sequence opt1 from hemagglutinin__InfluenzaA__AEO01111

SEQ ID NO: 68225 - RNA, 1701 nt, Artificial Sequence; identical to SEQ ID NO: 63677
  derived and/or modified sequence opt1 from hemagglutinin__InfluenzaA__AEO01112

SEQ ID NO: 68226 - RNA, 1701 nt, Artificial Sequence
  derived and/or modified sequence opt1 from hemagglutinin__InfluenzaA__AEO01113
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacagcuacccgaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucagcgacacgcccgugcacgacugcaacacgaccugccagacccccaagggcgccaucaacaccucccugccguuccagaacauccaccccaucaccaucgggaagugccccaaguacgucaagagcaccaagcuccggcuggcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 68227 - RNA, 1701 nt, Artificial Sequence; identical to SEQ ID NO: 63919
  derived and/or modified sequence opt1 from hemagglutinin__InfluenzaA__AEO01114

SEQ ID NO: 68228 - RNA, 1701 nt, Artificial Sequence
  derived and/or modified sequence opt1 from hemagglutinin__InfluenzaA__AEO01115
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacagcuacccgaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgccccaagguccgggaccaggagggccgcaugaacuacuacuggacccucguggagccgggggacaagaucaccuucgaggcgaccggcaaccugguggucccccgguacgccuucgccauggagcgcaacgccggguccggcaucaucaucagcgacacgcccgugcacgacugcaacacgaccugccagacccccaagggcgccaucaacaccucccugccguuccacaacauccaccccaucaccaucgggaagugccccaaguacgucaagagcaccaagcuccggcuggcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 68229 - RNA, 1701 nt, Artificial Sequence; identical to SEQ ID NO: 63677
  derived and/or modified sequence opt1 from hemagglutinin__InfluenzaA__AEO01116

SEQ ID NO: 68230 - RNA, 1701 nt, Artificial Sequence; identical to SEQ ID NO: 63677
  derived and/or modified sequence opt1 from hemagglutinin__InfluenzaA__AEO01117

SEQ ID NO: 68231 - RNA, 1701 nt, Artificial Sequence; identical to SEQ ID NO: 64543
  derived and/or modified sequence opt1 from hemagglutinin__InfluenzaA__AEO01118

SEQ ID NO: 68232 - RNA, 1701 nt, Artificial Sequence; identical to SEQ ID NO: 63677
  derived and/or modified sequence opt1 from hemagglutinin__InfluenzaA__AEO01119

SEQ ID NO: 68233 - RNA, 1701 nt, Artificial Sequence
  derived and/or modified sequence opt1 from hemagglutinin__InfluenzaA__AEO01120
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacgucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68234 - RNA, 1701 nt, Artificial Sequence; identical to SEQ ID NO: 63677
  derived and/or modified sequence opt1 from hemagglutinin__InfluenzaA__AEO01121

SEQ ID NO: 68235 - RNA, 1701 nt, Artificial Sequence; identical to SEQ ID NO: 64030
  derived and/or modified sequence opt1 from hemagglutinin__InfluenzaA__AEO01122

SEQ ID NO: 68236 - RNA, 1701 nt, Artificial Sequence; identical to SEQ ID NO: 63677
  derived and/or modified sequence opt1 from hemagglutinin__InfluenzaA__AEO01123

SEQ ID NO: 68237 - RNA, 1701 nt, Artificial Sequence; identical to SEQ ID NO: 63677
  derived and/or modified sequence opt1 from hemagglutinin__InfluenzaA__AEO01124

SEQ ID NO: 68238 - RNA, 1701 nt, Artificial Sequence; identical to SEQ ID NO: 64030
  derived and/or modified sequence opt1 from hemagglutinin__InfluenzaA__AEO01125

SEQ ID NO: 68239 - RNA, 1701 nt, Artificial Sequence
  derived and/or modified sequence opt1 from hemagglutinin__InfluenzaA__AEO01126
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68240 - RNA, 1701 nt, Artificial Sequence; identical to SEQ ID NO: 63677
  derived and/or modified sequence opt1 from hemagglutinin__InfluenzaA__AEO01127

SEQ ID NO: 68241 - RNA, 1701 nt, Artificial Sequence; identical to SEQ ID NO: 63677
  derived and/or modified sequence opt1 from hemagglutinin__InfluenzaA__AEO01128

SEQ ID NO: 68242 - RNA, 1701 nt, Artificial Sequence; identical to SEQ ID NO: 64030
  derived and/or modified sequence opt1 from hemagglutinin__InfluenzaA__AEO01129

SEQ ID NO: 68243 - RNA, 1701 nt, Artificial Sequence; identical to SEQ ID NO: 63677
  derived and/or modified sequence opt1 from hemagglutinin__InfluenzaA__AEO01130

SEQ ID NO: 68244 - RNA, 1701 nt, Artificial Sequence; identical to SEQ ID NO: 64030
  derived and/or modified sequence opt1 from hemagglutinin__InfluenzaA__AEO01131

SEQ ID NO: 68245 - RNA, 1701 nt, Artificial Sequence; identical to SEQ ID NO: 63677
  derived and/or modified sequence opt1 from hemagglutinin__InfluenzaA__AEO01132

SEQ ID NO: 68246 - RNA, 1701 nt, Artificial Sequence
  derived and/or modified sequence opt1 from hemagglutinin__InfluenzaA__AEO01133
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccaccaugaucuaccagauccucgcgaucuacagcaccgucgccagcucccuggugcugguggucagccucggggccaucuccuucuggaugugcagcaacggcucccugcagugccgcaucugcaucuga

SEQ ID NO: 68247 - RNA, 1701 nt, Artificial Sequence; identical to SEQ ID NO: 64030
  derived and/or modified sequence opt1 from hemagglutinin__InfluenzaA__AEO01134

SEQ ID NO: 68248 - RNA, 1701 nt, Artificial Sequence; identical to SEQ ID NO: 64030
  derived and/or modified sequence opt1 from hemagglutinin__InfluenzaA__AEO01135

SEQ ID NO: 68249 - RNA, 1701 nt, Artificial Sequence; identical to SEQ ID NO: 63677
  derived and/or modified sequence opt1 from hemagglutinin__InfluenzaA__AEO01136

SEQ ID NO: 68250 - RNA, 1701 nt, Artificial Sequence; identical to SEQ ID NO: 64124
  derived and/or modified sequence opt1 from hemagglutinin__InfluenzaA__AEO01137

SEQ ID NO: 68251 - RNA, 1701 nt, Artificial Sequence; identical to SEQ ID NO: 64124
  derived and/or modified sequence opt1 from hemagglutinin__InfluenzaA__AEO01138

SEQ ID NO: 68252 - RNA, 1701 nt, Artificial Sequence; identical to SEQ ID NO: 63677
  derived and/or modified sequence opt1 from hemagglutinin__InfluenzaA__AEO01139

SEQ ID NO: 68253 - RNA, 1701 nt, Artificial Sequence; identical to SEQ ID NO: 63677
  derived and/or modified sequence opt1 from hemagglutinin__InfluenzaA__AEO01140

SEQ ID NO: 68254 - RNA, 1701 nt, Artificial Sequence; identical to SEQ ID NO: 63677
  derived and/or modified sequence opt1 from hemagglutinin__InfluenzaA__AEO01141

SEQ ID NO: 68255 - RNA, 1701 nt, Artificial Sequence; identical to SEQ ID NO: 63677
  derived and/or modified sequence opt1 from hemagglutinin__InfluenzaA__AEO01142

SEQ ID NO: 68256 - RNA, 1701 nt, Artificial Sequence
  derived and/or modified sequence opt1 from hemagglutinin__InfluenzaA__AEO01144
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccaccagcgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcucccuggugcucguggucagccugggcgccaucagcuucuggaugugcuccaacggcagccugcagugccggaucugcaucuga

SEQ ID NO: 68257 - RNA, 1701 nt, Artificial Sequence; identical to SEQ ID NO: 63857
  derived and/or modified sequence opt1 from hemagglutinin__InfluenzaA__AEO01145

SEQ ID NO: 68258 - RNA, 1701 nt, Artificial Sequence
  derived and/or modified sequence opt1 from hemagglutinin__InfluenzaA__AEO01146
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaaccccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68259 - RNA, 1701 nt, Artificial Sequence; identical to SEQ ID NO: 63677
  derived and/or modified sequence opt1 from hemagglutinin__InfluenzaA__AEO01147

SEQ ID NO: 68260 - RNA, 1701 nt, Artificial Sequence; identical to SEQ ID NO: 64030
  derived and/or modified sequence opt1 from hemagglutinin__InfluenzaA__AEO01148

SEQ ID NO: 68261 - RNA, 1701 nt, Artificial Sequence; identical to SEQ ID NO: 64030
  derived and/or modified sequence opt1 from hemagglutinin__InfluenzaA__AEO01149

SEQ ID NO: 68262 - RNA, 1701 nt, Artificial Sequence; identical to SEQ ID NO: 66884
  derived and/or modified sequence opt1 from hemagglutinin__InfluenzaA__AEO01150

SEQ ID NO: 68263 - RNA, 1701 nt, Artificial Sequence; identical to SEQ ID NO: 63677
  derived and/or modified sequence opt1 from hemagglutinin__InfluenzaA__AEO01151

SEQ ID NO: 68264 - RNA, 1701 nt, Artificial Sequence
  derived and/or modified sequence opt1 from hemagglutinin__InfluenzaA__AEO01152
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcggggccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 68265 - RNA, 1701 nt, Artificial Sequence
  derived and/or modified sequence opt1 from hemagglutinin__InfluenzaA__AEO01153
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacaacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcaacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68266 - RNA, 1701 nt, Artificial Sequence; identical to SEQ ID NO: 63677
  derived and/or modified sequence opt1 from hemagglutinin__InfluenzaA__AEO01154

SEQ ID NO: 68267 - RNA, 1701 nt, Artificial Sequence; identical to SEQ ID NO: 64030
  derived and/or modified sequence opt1 from hemagglutinin__InfluenzaA__AEO01155

SEQ ID NO: 68268 - RNA, 1701 nt, Artificial Sequence; identical to SEQ ID NO: 64030
  derived and/or modified sequence opt1 from hemagglutinin__InfluenzaA__AEO01156

SEQ ID NO: 68269 - RNA, 1701 nt, Artificial Sequence; identical to SEQ ID NO: 63677
  derived and/or modified sequence opt1 from hemagglutinin__InfluenzaA__AEO01157

SEQ ID NO: 68270 - RNA, 1701 nt, Artificial Sequence; identical to SEQ ID NO: 63677
  derived and/or modified sequence opt1 from hemagglutinin__InfluenzaA__AEO01158

SEQ ID NO: 68271 - RNA, 1701 nt, Artificial Sequence; identical to SEQ ID NO: 63677
  derived and/or modified sequence opt1 from hemagglutinin__InfluenzaA__AEO01159

SEQ ID NO: 68272 - RNA, 1701 nt, Artificial Sequence
  derived and/or modified sequence opt1 from hemagglutinin__InfluenzaA__AEO01160
augaaggccauccugguggcccuccuguacaccuucgcgaccgccaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggagcaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 68273 - RNA, 1701 nt, Artificial Sequence; identical to SEQ ID NO: 63677
  derived and/or modified sequence opt1 from hemagglutinin__InfluenzaA__AEO01161

SEQ ID NO: 68274 - RNA, 1701 nt, Artificial Sequence; identical to SEQ ID NO: 64030
  derived and/or modified sequence opt1 from hemagglutinin__InfluenzaA__AEO01162

SEQ ID NO: 68275 - RNA, 1701 nt, Artificial Sequence; identical to SEQ ID NO: 64030
  derived and/or modified sequence opt1 from hemagglutinin__InfluenzaA__AEO01163

SEQ ID NO: 68276 - RNA, 1701 nt, Artificial Sequence; identical to SEQ ID NO: 64030
  derived and/or modified sequence opt1 from hemagglutinin__InfluenzaA__AEO01164

SEQ ID NO: 68277 - RNA, 1701 nt, Artificial Sequence
  derived and/or modified sequence opt1 from hemagglutinin__InfluenzaA__AEO01165
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaaguucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 68278 - RNA, 1701 nt, Artificial Sequence; identical to SEQ ID NO: 64030
  derived and/or modified sequence opt1 from hemagglutinin__InfluenzaA__AEO01166

SEQ ID NO: 68279 - RNA, 1701 nt, Artificial Sequence
  derived and/or modified sequence opt1 from hemagglutinin__InfluenzaA__AEO01167
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacguccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68280 - RNA, 1701 nt, Artificial Sequence; identical to SEQ ID NO: 63677
  derived and/or modified sequence opt1 from hemagglutinin__InfluenzaA__AEO01168

SEQ ID NO: 68281 - RNA, 1701 nt, Artificial Sequence; identical to SEQ ID NO: 64030
  derived and/or modified sequence opt1 from hemagglutinin__InfluenzaA__AEO01169

SEQ ID NO: 68282 - RNA, 1701 nt, Artificial Sequence; identical to SEQ ID NO: 64030
  derived and/or modified sequence opt1 from hemagglutinin__InfluenzaA__AEO01170

SEQ ID NO: 68283 - RNA, 1701 nt, Artificial Sequence; identical to SEQ ID NO: 64030
  derived and/or modified sequence opt1 from hemagglutinin__InfluenzaA__AEO01171

SEQ ID NO: 68284 - RNA, 1701 nt, Artificial Sequence; identical to SEQ ID NO: 63677
  derived and/or modified sequence opt1 from hemagglutinin__InfluenzaA__AEO01172

SEQ ID NO: 68285 - RNA, 1701 nt, Artificial Sequence
  derived and/or modified sequence opt1 from hemagglutinin__InfluenzaA__AEO01173
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccgggggcaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 68286 - RNA, 1701 nt, Artificial Sequence
  derived and/or modified sequence opt1 from hemagglutinin__InfluenzaA__AEO01174
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggagcaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 68287 - RNA, 1701 nt, Artificial Sequence; identical to SEQ ID NO: 63677
  derived and/or modified sequence opt1 from hemagglutinin__InfluenzaA__AEO01176

SEQ ID NO: 68288 - RNA, 1701 nt, Artificial Sequence; identical to SEQ ID NO: 63677
  derived and/or modified sequence opt1 from hemagglutinin__InfluenzaA__AEO01177

SEQ ID NO: 68289 - RNA, 1701 nt, Artificial Sequence; identical to SEQ ID NO: 64030
  derived and/or modified sequence opt1 from hemagglutinin__InfluenzaA__AEO01179

SEQ ID NO: 68290 - RNA, 1701 nt, Artificial Sequence; identical to SEQ ID NO: 64030
  derived and/or modified sequence opt1 from hemagglutinin__InfluenzaA__AEO01180

SEQ ID NO: 68291 - RNA, 1701 nt, Artificial Sequence; identical to SEQ ID NO: 64030
  derived and/or modified sequence opt1 from hemagglutinin__InfluenzaA__AEO01181

SEQ ID NO: 68292 - RNA, 1701 nt, Artificial Sequence; identical to SEQ ID NO: 64030
  derived and/or modified sequence opt1 from hemagglutinin__InfluenzaA__AEO01182

SEQ ID NO: 68293 - RNA, 1701 nt, Artificial Sequence; identical to SEQ ID NO: 63677
  derived and/or modified sequence opt1 from hemagglutinin__InfluenzaA__AEO01183

SEQ ID NO: 68294 - RNA, 1701 nt, Artificial Sequence; identical to SEQ ID NO: 64030
  derived and/or modified sequence opt1 from hemagglutinin__InfluenzaA__AEO01184

SEQ ID NO: 68295 - RNA, 1701 nt, Artificial Sequence; identical to SEQ ID NO: 63677
  derived and/or modified sequence opt1 from hemagglutinin__InfluenzaA__AEO01185

SEQ ID NO: 68296 - RNA, 1701 nt, Artificial Sequence; identical to SEQ ID NO: 63677
  derived and/or modified sequence opt1 from hemagglutinin__InfluenzaA__AEO01186

SEQ ID NO: 68297 - RNA, 1701 nt, Artificial Sequence; identical to SEQ ID NO: 63677
  derived and/or modified sequence opt1 from hemagglutinin__InfluenzaA__AEO01187

SEQ ID NO: 68298 - RNA, 1701 nt, Artificial Sequence; identical to SEQ ID NO: 63677
  derived and/or modified sequence opt1 from hemagglutinin__InfluenzaA__AEO01188

SEQ ID NO: 68299 - RNA, 1701 nt, Artificial Sequence; identical to SEQ ID NO: 63677
  derived and/or modified sequence opt1 from hemagglutinin__InfluenzaA__AEO01189

SEQ ID NO: 68300 - RNA, 1701 nt, Artificial Sequence; identical to SEQ ID NO: 63677
  derived and/or modified sequence opt1 from hemagglutinin__InfluenzaA__AEO01191

SEQ ID NO: 68301 - RNA, 1701 nt, Artificial Sequence; identical to SEQ ID NO: 63677
  derived and/or modified sequence opt1 from hemagglutinin__InfluenzaA__AEO01192

SEQ ID NO: 68302 - RNA, 1701 nt, Artificial Sequence; identical to SEQ ID NO: 64991
  derived and/or modified sequence opt1 from hemagglutinin__InfluenzaA__AEO01193

SEQ ID NO: 68303 - RNA, 1701 nt, Artificial Sequence; identical to SEQ ID NO: 64030
  derived and/or modified sequence opt1 from hemagglutinin__InfluenzaA__AEO01194

SEQ ID NO: 68304 - RNA, 1701 nt, Artificial Sequence; identical to SEQ ID NO: 64030
  derived and/or modified sequence opt1 from hemagglutinin__InfluenzaA__AEO01195

SEQ ID NO: 68305 - RNA, 1701 nt, Artificial Sequence; identical to SEQ ID NO: 63677
  derived and/or modified sequence opt1 from hemagglutinin__InfluenzaA__AEO01196

SEQ ID NO: 68306 - RNA, 1701 nt, Artificial Sequence; identical to SEQ ID NO: 63677
  derived and/or modified sequence opt1 from hemagglutinin__InfluenzaA__AEO01197

SEQ ID NO: 68307 - RNA, 1701 nt, Artificial Sequence; identical to SEQ ID NO: 64030
  derived and/or modified sequence opt1 from hemagglutinin__InfluenzaA__AEO01198

SEQ ID NO: 68308 - RNA, 1701 nt, Artificial Sequence; identical to SEQ ID NO: 64543
  derived and/or modified sequence opt1 from hemagglutinin__InfluenzaA__AEO01200

SEQ ID NO: 68309 - RNA, 1701 nt, Artificial Sequence
  derived and/or modified sequence opt1 from hemagglutinin__InfluenzaA__AEO01201
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggagaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68310 - RNA, 1701 nt, Artificial Sequence; identical to SEQ ID NO: 63677
  derived and/or modified sequence opt1 from hemagglutinin__InfluenzaA__AEO01202

SEQ ID NO: 68311 - RNA, 1701 nt, Artificial Sequence; identical to SEQ ID NO: 65313
  derived and/or modified sequence opt1 from hemagglutinin__InfluenzaA__AEO01203

SEQ ID NO: 68312 - RNA, 1701 nt, Artificial Sequence; identical to SEQ ID NO: 63677
  derived and/or modified sequence opt1 from hemagglutinin__InfluenzaA__AEO01204

SEQ ID NO: 68313 - RNA, 1701 nt, Artificial Sequence; identical to SEQ ID NO: 63677
  derived and/or modified sequence opt1 from hemagglutinin__InfluenzaA__AEO01205

SEQ ID NO: 68314 - RNA, 1701 nt, Artificial Sequence; identical to SEQ ID NO: 63677
  derived and/or modified sequence opt1 from hemagglutinin__InfluenzaA__AEO01206

SEQ ID NO: 68315 - RNA, 1701 nt, Artificial Sequence; identical to SEQ ID NO: 63677
  derived and/or modified sequence opt1 from hemagglutinin__InfluenzaA__AEO01207

SEQ ID NO: 68316 - RNA, 1701 nt, Artificial Sequence; identical to SEQ ID NO: 63677
  derived and/or modified sequence opt1 from hemagglutinin__InfluenzaA__AEO01208

SEQ ID NO: 68317 - RNA, 1701 nt, Artificial Sequence; identical to SEQ ID NO: 64030
  derived and/or modified sequence opt1 from hemagglutinin__InfluenzaA__AEO01209

SEQ ID NO: 68318 - RNA, 1701 nt, Artificial Sequence; identical to SEQ ID NO: 63677
  derived and/or modified sequence opt1 from hemagglutinin__InfluenzaA__AEO01210

SEQ ID NO: 68319 - RNA, 1701 nt, Artificial Sequence; identical to SEQ ID NO: 64030
  derived and/or modified sequence opt1 from hemagglutinin__InfluenzaA__AEO01211

SEQ ID NO: 68320 - RNA, 1701 nt, Artificial Sequence; identical to SEQ ID NO: 63677
  derived and/or modified sequence opt1 from hemagglutinin__InfluenzaA__AEO01212

SEQ ID NO: 68321 - RNA, 1701 nt, Artificial Sequence; identical to SEQ ID NO: 63677
  derived and/or modified sequence opt1 from hemagglutinin__InfluenzaA__AEO01213

SEQ ID NO: 68322 - RNA, 1701 nt, Artificial Sequence
  derived and/or modified sequence opt1 from hemagglutinin__InfluenzaA__AEO01214
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggcgccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 68323 - RNA, 1701 nt, Artificial Sequence; identical to SEQ ID NO: 64030
  derived and/or modified sequence opt1 from hemagglutinin__InfluenzaA__AEO01215

SEQ ID NO: 68324 - RNA, 1701 nt, Artificial Sequence
  derived and/or modified sequence opt1 from hemagglutinin__InfluenzaA__AEO01216
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcgucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 68325 - RNA, 1701 nt, Artificial Sequence; identical to SEQ ID NO: 64030
  derived and/or modified sequence opt1 from hemagglutinin__InfluenzaA__AEO01217

SEQ ID NO: 68326 - RNA, 1701 nt, Artificial Sequence; identical to SEQ ID NO: 64030
  derived and/or modified sequence opt1 from hemagglutinin__InfluenzaA__AEO01218

SEQ ID NO: 68327 - RNA, 1701 nt, Artificial Sequence; identical to SEQ ID NO: 64030
  derived and/or modified sequence opt1 from hemagglutinin__InfluenzaA__AEO01219

SEQ ID NO: 68328 - RNA, 1701 nt, Artificial Sequence; identical to SEQ ID NO: 63768
  derived and/or modified sequence opt1 from hemagglutinin__InfluenzaA__AEO01220

SEQ ID NO: 68329 - RNA, 1701 nt, Artificial Sequence; identical to SEQ ID NO: 63677
  derived and/or modified sequence opt1 from hemagglutinin__InfluenzaA__AEO01221

SEQ ID NO: 68330 - RNA, 1701 nt, Artificial Sequence; identical to SEQ ID NO: 63677
  derived and/or modified sequence opt1 from hemagglutinin__InfluenzaA__AEO01222

SEQ ID NO: 68331 - RNA, 1701 nt, Artificial Sequence; identical to SEQ ID NO: 64030
  derived and/or modified sequence opt1 from hemagglutinin__InfluenzaA__AEO01223

SEQ ID NO: 68332 - RNA, 1701 nt, Artificial Sequence
  derived and/or modified sequence opt1 from hemagglutinin__InfluenzaA__AEO01224
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccacggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68333 - RNA, 1701 nt, Artificial Sequence
  derived and/or modified sequence opt1 from hemagglutinin__InfluenzaA__AEO01225
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggaccgugguggagcccggggacaagaucaccuucgaggcgaccggcaaccuggucgugccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccguggccagcagccuggugcuggucgugucccucggggccaucagcuucuggaugugcuccaacggcagccugcagugccggaucugcaucuga

SEQ ID NO: 68334 - RNA, 1701 nt, Artificial Sequence
  derived and/or modified sequence opt1 from hemagglutinin__InfluenzaA__AEO01226
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgacggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68335 - RNA, 1701 nt, Artificial Sequence; identical to SEQ ID NO: 65844
  derived and/or modified sequence opt1 from hemagglutinin__InfluenzaA__AEO01227

SEQ ID NO: 68336 - RNA, 1701 nt, Artificial Sequence; identical to SEQ ID NO: 63677
  derived and/or modified sequence opt1 from hemagglutinin__InfluenzaA__AEO01228

SEQ ID NO: 68337 - RNA, 1701 nt, Artificial Sequence; identical to SEQ ID NO: 63677
  derived and/or modified sequence opt1 from hemagglutinin__InfluenzaA__AEO01229

SEQ ID NO: 68338 - RNA, 1701 nt, Artificial Sequence
  derived and/or modified sequence opt1 from hemagglutinin__InfluenzaA__AEO01230
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68339 - RNA, 1701 nt, Artificial Sequence; identical to SEQ ID NO: 63677
  derived and/or modified sequence opt1 from hemagglutinin__InfluenzaA__AEO01231

SEQ ID NO: 68340 - RNA, 1701 nt, Artificial Sequence; identical to SEQ ID NO: 64030
  derived and/or modified sequence opt1 from hemagglutinin__InfluenzaA__AEO01232

SEQ ID NO: 68341 - RNA, 1701 nt, Artificial Sequence; identical to SEQ ID NO: 63677
  derived and/or modified sequence opt1 from hemagglutinin__InfluenzaA__AEO01233

SEQ ID NO: 68342 - RNA, 1701 nt, Artificial Sequence; identical to SEQ ID NO: 63677
  derived and/or modified sequence opt1 from hemagglutinin__InfluenzaA__AEO01234

SEQ ID NO: 68343 - RNA, 1701 nt, Artificial Sequence; identical to SEQ ID NO: 63677
  derived and/or modified sequence opt1 from hemagglutinin__InfluenzaA__AEO01235

SEQ ID NO: 68344 - RNA, 1701 nt, Artificial Sequence; identical to SEQ ID NO: 67549
  derived and/or modified sequence opt1 from hemagglutinin__InfluenzaA__AEO01236

SEQ ID NO: 68345 - RNA, 1701 nt, Artificial Sequence; identical to SEQ ID NO: 63677
  derived and/or modified sequence opt1 from hemagglutinin__InfluenzaA__AEO01237

SEQ ID NO: 68346 - RNA, 1701 nt, Artificial Sequence; identical to SEQ ID NO: 63677
  derived and/or modified sequence opt1 from hemagglutinin__InfluenzaA__AEO01238

SEQ ID NO: 68347 - RNA, 1701 nt, Artificial Sequence; identical to SEQ ID NO: 63677
  derived and/or modified sequence opt1 from hemagglutinin__InfluenzaA__AEO01240

SEQ ID NO: 68348 - RNA, 1701 nt, Artificial Sequence; identical to SEQ ID NO: 64030
  derived and/or modified sequence opt1 from hemagglutinin__InfluenzaA__AEO01241

SEQ ID NO: 68349 - RNA, 1701 nt, Artificial Sequence; identical to SEQ ID NO: 63677
  derived and/or modified sequence opt1 from hemagglutinin__InfluenzaA__AEO01242

SEQ ID NO: 68350 - RNA, 1701 nt, Artificial Sequence
  derived and/or modified sequence opt1 from hemagglutinin__InfluenzaA__AEO01244
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcggccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 68351 - RNA, 1701 nt, Artificial Sequence; identical to SEQ ID NO: 63677
  derived and/or modified sequence opt1 from hemagglutinin__InfluenzaA__AEO01245

SEQ ID NO: 68352 - RNA, 1701 nt, Artificial Sequence
  derived and/or modified sequence opt1 from hemagglutinin__InfluenzaA__AEO01247
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcauccugaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 68353 - RNA, 1701 nt, Artificial Sequence; identical to SEQ ID NO: 63677
  derived and/or modified sequence opt1 from hemagglutinin__InfluenzaA__AEO01248

SEQ ID NO: 68354 - RNA, 1701 nt, Artificial Sequence; identical to SEQ ID NO: 63677
  derived and/or modified sequence opt1 from hemagglutinin__InfluenzaA__AEO01249

SEQ ID NO: 68355 - RNA, 1701 nt, Artificial Sequence
  derived and/or modified sequence opt1 from hemagglutinin__InfluenzaA__AEO01250
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgaggacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68356 - RNA, 1701 nt, Artificial Sequence; identical to SEQ ID NO: 65274
  derived and/or modified sequence opt1 from hemagglutinin__InfluenzaA__AEO01251

SEQ ID NO: 68357 - RNA, 1701 nt, Artificial Sequence; identical to SEQ ID NO: 63677
  derived and/or modified sequence opt1 from hemagglutinin__InfluenzaA__AEO01252

SEQ ID NO: 68358 - RNA, 1701 nt, Artificial Sequence; identical to SEQ ID NO: 63677
  derived and/or modified sequence opt1 from hemagglutinin__InfluenzaA__AEO01253

SEQ ID NO: 68359 - RNA, 1701 nt, Artificial Sequence
  derived and/or modified sequence opt1 from hemagglutinin__InfluenzaA__AEO01254
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacaacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68360 - RNA, 1701 nt, Artificial Sequence; identical to SEQ ID NO: 64124
  derived and/or modified sequence opt1 from hemagglutinin__InfluenzaA__AEO01256

SEQ ID NO: 68361 - RNA, 1701 nt, Artificial Sequence; identical to SEQ ID NO: 67096
  derived and/or modified sequence opt1 from hemagglutinin__InfluenzaA__AEO01257

SEQ ID NO: 68362 - RNA, 1701 nt, Artificial Sequence; identical to SEQ ID NO: 63677
  derived and/or modified sequence opt1 from hemagglutinin__InfluenzaA__AEO01258

SEQ ID NO: 68363 - RNA, 1701 nt, Artificial Sequence; identical to SEQ ID NO: 68359
  derived and/or modified sequence opt1 from hemagglutinin__InfluenzaA__AEO01259

SEQ ID NO: 68364 - RNA, 1701 nt, Artificial Sequence; identical to SEQ ID NO: 66232
  derived and/or modified sequence opt1 from hemagglutinin__InfluenzaA__AEO01260

SEQ ID NO: 68365 - RNA, 1701 nt, Artificial Sequence
  derived and/or modified sequence opt1 from hemagglutinin__InfluenzaA__AEO01261
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcaccgggaucuaccagauccucgcgaucuacuccaccgucgccagcagccuggugcugguggucucccucggcgccaucagcuucuggaugugcuccaacggcagccugcagugccgcaucugcaucuga

SEQ ID NO: 68366 - RNA, 1701 nt, Artificial Sequence; identical to SEQ ID NO: 63677
  derived and/or modified sequence opt1 from hemagglutinin__InfluenzaA__AEO01262

SEQ ID NO: 68367 - RNA, 1701 nt, Artificial Sequence; identical to SEQ ID NO: 65359
  derived and/or modified sequence opt1 from hemagglutinin__InfluenzaA__AEO01263

SEQ ID NO: 68368 - RNA, 1701 nt, Artificial Sequence; identical to SEQ ID NO: 64030
  derived and/or modified sequence opt1 from hemagglutinin__InfluenzaA__AEO01264

SEQ ID NO: 68369 - RNA, 1701 nt, Artificial Sequence; identical to SEQ ID NO: 63677
  derived and/or modified sequence opt1 from hemagglutinin__InfluenzaA__AEO01265

SEQ ID NO: 68370 - RNA, 1701 nt, Artificial Sequence
  derived and/or modified sequence opt1 from hemagglutinin__InfluenzaA__AEO01266
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacgcccccgugcacgacugcaacacgaccugccagaccccgaagggggcgaucaacaccucccugcccuuccagaacauccaccccaucacgaucggcaagugccccaaguacgucaagagcaccaagcugcggcucgccaccgggcugcgcaacgugccguccauccagagccggggccuguucggggccaucgccggcuucaucgagggcggguggaccggcaugguggacgggugguacggcuaccaccaccagaacgagcagggguccggcuacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcucgagagcacccgcaucuaccagauccuggccaucuacuccaccgucgccagcagccuggugcucguggucucccugggcgccaucagcuucuggaugugcuccaacggcagccugcagugccggaucugcaucuga

SEQ ID NO: 68371 - RNA, 1701 nt, Artificial Sequence; identical to SEQ ID NO: 63677
  derived and/or modified sequence opt1 from hemagglutinin__InfluenzaA__AEO01267

SEQ ID NO: 68372 - RNA, 1701 nt, Artificial Sequence; identical to SEQ ID NO: 63677
  derived and/or modified sequence opt1 from hemagglutinin__InfluenzaA__AEO01268

SEQ ID NO: 68373 - RNA, 1701 nt, Artificial Sequence
  derived and/or modified sequence opt1 from hemagglutinin__InfluenzaA__AEO01269
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucgugaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcauggagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 68374 - RNA, 1701 nt, Artificial Sequence; identical to SEQ ID NO: 64841
  derived and/or modified sequence opt1 from hemagglutinin__InfluenzaA__AEO01270

SEQ ID NO: 68375 - RNA, 1701 nt, Artificial Sequence
  derived and/or modified sequence opt1 from hemagglutinin__InfluenzaA__AEO01271
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68376 - RNA, 1701 nt, Artificial Sequence; identical to SEQ ID NO: 63677
  derived and/or modified sequence opt1 from hemagglutinin__InfluenzaA__AEO01272

SEQ ID NO: 68377 - RNA, 1701 nt, Artificial Sequence; identical to SEQ ID NO: 63677
  derived and/or modified sequence opt1 from hemagglutinin__InfluenzaA__AEO01273

SEQ ID NO: 68378 - RNA, 1701 nt, Artificial Sequence; identical to SEQ ID NO: 63677
  derived and/or modified sequence opt1 from hemagglutinin__InfluenzaA__AEO01274

SEQ ID NO: 68379 - RNA, 1701 nt, Artificial Sequence; identical to SEQ ID NO: 65845
  derived and/or modified sequence opt1 from hemagglutinin__InfluenzaA__AEO01275

SEQ ID NO: 68380 - RNA, 1701 nt, Artificial Sequence
  derived and/or modified sequence opt1 from hemagglutinin__InfluenzaA__AEO01276
augaaggccauccuggugguccuccuguacaccuucgccaccgcgaacgccgacacgcugugcaucggcuaccacgccaacaacagcaccgacaccguggacaccgugcucaagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccgaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68381 - RNA, 1701 nt, Artificial Sequence; identical to SEQ ID NO: 63677
  derived and/or modified sequence opt1 from hemagglutinin__InfluenzaA__AEO01277

SEQ ID NO: 68382 - RNA, 1701 nt, Artificial Sequence
  derived and/or modified sequence opt1 from hemagglutinin__InfluenzaA__AEO01278
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgccaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 68383 - RNA, 1701 nt, Artificial Sequence
  derived and/or modified sequence opt1 from hemagglutinin__InfluenzaA__AEO01279
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcacggccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68384 - RNA, 1701 nt, Artificial Sequence
  derived and/or modified sequence opt1 from hemagglutinin__InfluenzaA__AEO01282
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaagcucuacgagaagguccgcucccagcugaagaacaacgccaaggagaucgggaacggcugcuucgaguucuaccacaagugcaacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68385 - RNA, 1701 nt, Artificial Sequence; identical to SEQ ID NO: 64779
  derived and/or modified sequence opt1 from hemagglutinin__InfluenzaA__AEO01283

SEQ ID NO: 68386 - RNA, 1701 nt, Artificial Sequence
  derived and/or modified sequence opt1 from hemagglutinin__InfluenzaA__AEO01284
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucaacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68387 - RNA, 1701 nt, Artificial Sequence; identical to SEQ ID NO: 64778
  derived and/or modified sequence opt1 from hemagglutinin__InfluenzaA__AEO01285

SEQ ID NO: 68388 - RNA, 1701 nt, Artificial Sequence; identical to SEQ ID NO: 64871
  derived and/or modified sequence opt1 from hemagglutinin__InfluenzaA__AEO01286

SEQ ID NO: 68389 - RNA, 1701 nt, Artificial Sequence
  derived and/or modified sequence opt1 from hemagglutinin__InfluenzaA__AEO01287
augaaggccauccuggugguccuccuguacaccuucgccaccgcgaacagcgacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 68390 - RNA, 1701 nt, Artificial Sequence; identical to SEQ ID NO: 64030
  derived and/or modified sequence opt1 from hemagglutinin__InfluenzaA__AEO01288

SEQ ID NO: 68391 - RNA, 1701 nt, Artificial Sequence; identical to SEQ ID NO: 63677
  derived and/or modified sequence opt1 from hemagglutinin__InfluenzaA__AEO01289

SEQ ID NO: 68392 - RNA, 1701 nt, Artificial Sequence
  derived and/or modified sequence opt1 from hemagglutinin__InfluenzaA__AEO01290
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugagcuuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68393 - RNA, 1701 nt, Artificial Sequence; identical to SEQ ID NO: 63677
  derived and/or modified sequence opt1 from hemagglutinin__InfluenzaA__AEO01291

SEQ ID NO: 68394 - RNA, 1701 nt, Artificial Sequence; identical to SEQ ID NO: 63677
  derived and/or modified sequence opt1 from hemagglutinin__InfluenzaA__AEO01292

SEQ ID NO: 68395 - RNA, 1701 nt, Artificial Sequence
  derived and/or modified sequence opt1 from hemagglutinin__InfluenzaA__AEO01294
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68396 - RNA, 1701 nt, Artificial Sequence
  derived and/or modified sequence opt1 from hemagglutinin__InfluenzaA__AEO01295
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacuacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68397 - RNA, 1701 nt, Artificial Sequence; identical to SEQ ID NO: 63677
  derived and/or modified sequence opt1 from hemagglutinin__InfluenzaA__AEO01296

SEQ ID NO: 68398 - RNA, 1701 nt, Artificial Sequence; identical to SEQ ID NO: 65359
  derived and/or modified sequence opt1 from hemagglutinin__InfluenzaA__AEO01297

SEQ ID NO: 68399 - RNA, 1701 nt, Artificial Sequence; identical to SEQ ID NO: 65364
  derived and/or modified sequence opt1 from hemagglutinin__InfluenzaA__AEO01298

SEQ ID NO: 68400 - RNA, 1701 nt, Artificial Sequence; identical to SEQ ID NO: 63677
  derived and/or modified sequence opt1 from hemagglutinin__InfluenzaA__AEO01299

SEQ ID NO: 68401 - RNA, 1701 nt, Artificial Sequence; identical to SEQ ID NO: 63677
  derived and/or modified sequence opt1 from hemagglutinin__InfluenzaA__AEO01300

SEQ ID NO: 68402 - RNA, 1701 nt, Artificial Sequence; identical to SEQ ID NO: 63677
  derived and/or modified sequence opt1 from hemagglutinin__InfluenzaA__AEO01301

SEQ ID NO: 68403 - RNA, 1701 nt, Artificial Sequence; identical to SEQ ID NO: 63677
  derived and/or modified sequence opt1 from hemagglutinin__InfluenzaA__AEO01302

SEQ ID NO: 68404 - RNA, 1701 nt, Artificial Sequence; identical to SEQ ID NO: 65274
  derived and/or modified sequence opt1 from hemagglutinin__InfluenzaA__AEO01303

SEQ ID NO: 68405 - RNA, 1701 nt, Artificial Sequence
  derived and/or modified sequence opt1 from hemagglutinin__InfluenzaA__AEO01304
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaaggccagcuccuggcccaaccacgacagcaacaagggggucaccgccgccugcccgcacgcgggcgccaaguccuucuacaagaaccugaucuggcucgugaagaaggggaacagcuaccccaagcuguccaagagcuacaucaacgacaagggcaagggggugcugguccucuggggcauccaccaccccagcaccuccgccgaccagcagagccuguaccagaacgccgacgccuacguguucgugggcaccucccgguacagcaagaaguucaagcccgagaucgcgauccgcccgaagguccgggaccaggaggggcgcaugaacuacuacuggacgcugguggagcccggcgacaagaucaccuucgaggccaccgggaaccucguggucccccgguacgccuucgccauggagcgcaacgccggcuccggcaucaucaucagcgacacccccgugcacgacugcaacacgaccugccagaccccgaagggggcgaucaacaccucccugcccuuccagaacauccaccccaucacgaucggcaagugccccaaguacgucaagagcaccaagcugcggcucgccaccgggcugcgcaacgugccguccauccagagccggggccuguucggggccaucgccggcuucaucgagggcggguggaccggcaugguggacgggugguacggcuaccaccaccagaacgagcagggguccggcuacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcucgagagcacccgcaucuaccagauccuggccaucuacuccaccgucgccagcagccuggugcucguggucucccugggcgccaucagcuucuggaugugcuccaacggcagccugcagugccggaucugcaucuga

SEQ ID NO: 68406 - RNA, 1701 nt, Artificial Sequence
  derived and/or modified sequence opt1 from hemagglutinin__InfluenzaA__AEO01305
augaaggccauccuggugguccuccuguacaccuucgccaccgcgagcgccgacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgcguccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68407 - RNA, 1701 nt, Artificial Sequence; identical to SEQ ID NO: 63677
  derived and/or modified sequence opt1 from hemagglutinin__InfluenzaA__AEO01306

SEQ ID NO: 68408 - RNA, 1701 nt, Artificial Sequence; identical to SEQ ID NO: 63677
  derived and/or modified sequence opt1 from hemagglutinin__InfluenzaA__AEO01307

SEQ ID NO: 68409 - RNA, 1701 nt, Artificial Sequence; identical to SEQ ID NO: 63677
  derived and/or modified sequence opt1 from hemagglutinin__InfluenzaA__AEO01308

SEQ ID NO: 68410 - RNA, 1701 nt, Artificial Sequence
  derived and/or modified sequence opt1 from hemagglutinin__InfluenzaA__AEO01309
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucaacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68411 - RNA, 1701 nt, Artificial Sequence
  derived and/or modified sequence opt1 from hemagglutinin__InfluenzaA__AEO01310
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgaccggggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68412 - RNA, 1701 nt, Artificial Sequence; identical to SEQ ID NO: 63677
  derived and/or modified sequence opt1 from hemagglutinin__InfluenzaA__AEO01311

SEQ ID NO: 68413 - RNA, 1701 nt, Artificial Sequence
  derived and/or modified sequence opt1 from hemagglutinin__InfluenzaA__AEO01312
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaucguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68414 - RNA, 1701 nt, Artificial Sequence; identical to SEQ ID NO: 64030
  derived and/or modified sequence opt1 from hemagglutinin__InfluenzaA__AEO01313

SEQ ID NO: 68415 - RNA, 1701 nt, Artificial Sequence; identical to SEQ ID NO: 64841
  derived and/or modified sequence opt1 from hemagglutinin__InfluenzaA__AEO01314

SEQ ID NO: 68416 - RNA, 1701 nt, Artificial Sequence
  derived and/or modified sequence opt1 from hemagglutinin__InfluenzaA__AEO01315
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgcuacagcaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacgggagccugcagugccgcaucugcaucuga

SEQ ID NO: 68417 - RNA, 1701 nt, Artificial Sequence; identical to SEQ ID NO: 63677
  derived and/or modified sequence opt1 from hemagglutinin__InfluenzaA__AEO01316

SEQ ID NO: 68418 - RNA, 1701 nt, Artificial Sequence; identical to SEQ ID NO: 63677
  derived and/or modified sequence opt1 from hemagglutinin__InfluenzaA__AEO01317

SEQ ID NO: 68419 - RNA, 1701 nt, Artificial Sequence; identical to SEQ ID NO: 63677
  derived and/or modified sequence opt1 from hemagglutinin__InfluenzaA__AEO01318

SEQ ID NO: 68420 - RNA, 1701 nt, Artificial Sequence; identical to SEQ ID NO: 63677
  derived and/or modified sequence opt1 from hemagglutinin__InfluenzaA__AEO01319

SEQ ID NO: 68421 - RNA, 1701 nt, Artificial Sequence
  derived and/or modified sequence opt1 from hemagglutinin__InfluenzaA__AEO01321
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggcccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcuggagagcacccgcaucuaccagauccucgccaucuacuccaccguggccagcagccugguccugguggugucccucggggccaucagcuucuggaugugcuccaacggcagccugcagugccggaucugcaucuga

SEQ ID NO: 68422 - RNA, 1701 nt, Artificial Sequence; identical to SEQ ID NO: 63677
  derived and/or modified sequence opt1 from hemagglutinin__InfluenzaA__AEO01322

SEQ ID NO: 68423 - RNA, 1701 nt, Artificial Sequence; identical to SEQ ID NO: 65359
  derived and/or modified sequence opt1 from hemagglutinin__InfluenzaA__AEO01323

SEQ ID NO: 68424 - RNA, 1701 nt, Artificial Sequence; identical to SEQ ID NO: 65274
  derived and/or modified sequence opt1 from hemagglutinin__InfluenzaA__AEO01324

SEQ ID NO: 68425 - RNA, 1701 nt, Artificial Sequence; identical to SEQ ID NO: 63677
  derived and/or modified sequence opt1 from hemagglutinin__InfluenzaA__AEO01325

SEQ ID NO: 68426 - RNA, 1701 nt, Artificial Sequence
  derived and/or modified sequence opt1 from hemagglutinin__InfluenzaA__AEO01326
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccaggacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68427 - RNA, 1701 nt, Artificial Sequence; identical to SEQ ID NO: 63677
  derived and/or modified sequence opt1 from hemagglutinin__InfluenzaA__AEO01327

SEQ ID NO: 68428 - RNA, 1701 nt, Artificial Sequence; identical to SEQ ID NO: 68386
  derived and/or modified sequence opt1 from hemagglutinin__InfluenzaA__AEO01328

SEQ ID NO: 68429 - RNA, 1701 nt, Artificial Sequence; identical to SEQ ID NO: 63677
  derived and/or modified sequence opt1 from hemagglutinin__InfluenzaA__AEO01330

SEQ ID NO: 68430 - RNA, 1701 nt, Artificial Sequence
  derived and/or modified sequence opt1 from hemagglutinin__InfluenzaA__AEO01331
augaaggccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggcgaucuacuccaccguggccagcagccucguccugguggugucccugggggccaucagcuucuggaugugcuccaacggcagccuccagugccggaucugcaucuga

SEQ ID NO: 68431 - RNA, 1701 nt, Artificial Sequence
  derived and/or modified sequence opt1 from hemagglutinin__InfluenzaA__AEO01332
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggccugucccgguacagcaagaaguucaagcccgagaucgccauccgcccgaagguccgggagcaggagggccgcaugaacuacuacuggacgcucguggagcccggggacaagaucaccuucgaggcgaccggcaaccugguggucccccgguacgccuucgccauggagcgcaacgccggguccggcaucgugaucagcgacacccccgugcacgacugcaacacgaccugccagaccccgaagggcgccaucaacaccucccugcccuuccagaacauccaccccaucacgaucgggaagugccccaaguacgucaagagcaccaagcuccggcuggcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggucaacuccgugaucgagaagaugaacacccaguucaccgccgucggcaaggaguucaaccaccuggagaagcgcauggagaaccucaacaagaagguggacgacggcuuccuggacaucuggacguacaacgccgagcugcucgugcugcuggagaacgagcggacccucgacuaccacgacagcaacgucaagaaccuguacgagaaggugcgcucccagcugaagaccaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgucaagcuggagagcacccgcaucuaccagauccuggcgaucuacuccaccguggccagcagccucgugcuggucgugucccugggggccaucagcuucuggaugugcuccaacggcagccuccagugccggaucugcaucuga

SEQ ID NO: 68432 - RNA, 1701 nt, Artificial Sequence; identical to SEQ ID NO: 65845
  derived and/or modified sequence opt1 from hemagglutinin__InfluenzaA__AEO01333

SEQ ID NO: 68433 - RNA, 1701 nt, Artificial Sequence
  derived and/or modified sequence opt1 from hemagglutinin__InfluenzaA__AEO01334
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 68434 - RNA, 1701 nt, Artificial Sequence; identical to SEQ ID NO: 65274
  derived and/or modified sequence opt1 from hemagglutinin__InfluenzaA__AEO01335

SEQ ID NO: 68435 - RNA, 1701 nt, Artificial Sequence
  derived and/or modified sequence opt1 from hemagglutinin__InfluenzaA__AEO01336
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucggggagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68436 - RNA, 1701 nt, Artificial Sequence
  derived and/or modified sequence opt1 from hemagglutinin__InfluenzaA__AEO01337
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68437 - RNA, 1701 nt, Artificial Sequence; identical to SEQ ID NO: 63677
  derived and/or modified sequence opt1 from hemagglutinin__InfluenzaA__AEO01338

SEQ ID NO: 68438 - RNA, 1701 nt, Artificial Sequence; identical to SEQ ID NO: 67549
  derived and/or modified sequence opt1 from hemagglutinin__InfluenzaA__AEO01339

SEQ ID NO: 68439 - RNA, 1701 nt, Artificial Sequence; identical to SEQ ID NO: 68395
  derived and/or modified sequence opt1 from hemagglutinin__InfluenzaA__AEO01340

SEQ ID NO: 68440 - RNA, 1701 nt, Artificial Sequence; identical to SEQ ID NO: 68395
  derived and/or modified sequence opt1 from hemagglutinin__InfluenzaA__AEO01341

SEQ ID NO: 68441 - RNA, 1701 nt, Artificial Sequence; identical to SEQ ID NO: 63677
  derived and/or modified sequence opt1 from hemagglutinin__InfluenzaA__AEO01342

SEQ ID NO: 68442 - RNA, 1701 nt, Artificial Sequence
  derived and/or modified sequence opt1 from hemagglutinin__InfluenzaA__AEO01343
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68443 - RNA, 1701 nt, Artificial Sequence
  derived and/or modified sequence opt1 from hemagglutinin__InfluenzaA__AEO01344
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagcggaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagagcacccggaucuaccagauccucgcgaucuacuccaccgucgccagcagccuggugcugguggucucccucggggccaucagcuucuggaugugcuccaacggcagccugcagugccgcaucugcaucuga

SEQ ID NO: 68444 - RNA, 1701 nt, Artificial Sequence; identical to SEQ ID NO: 67549
  derived and/or modified sequence opt1 from hemagglutinin__InfluenzaA__AEO01345

SEQ ID NO: 68445 - RNA, 1701 nt, Artificial Sequence; identical to SEQ ID NO: 63677
  derived and/or modified sequence opt1 from hemagglutinin__InfluenzaA__AEO01346

SEQ ID NO: 68446 - RNA, 1701 nt, Artificial Sequence
  derived and/or modified sequence opt1 from hemagglutinin__InfluenzaA__AEO01347
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68447 - RNA, 1701 nt, Artificial Sequence
  derived and/or modified sequence opt1 from hemagglutinin__InfluenzaA__AEO01348
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggagcaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68448 - RNA, 1701 nt, Artificial Sequence
  derived and/or modified sequence opt1 from hemagglutinin__InfluenzaA__AEO01349
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgagaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68449 - RNA, 1701 nt, Artificial Sequence
  derived and/or modified sequence opt1 from hemagglutinin__InfluenzaA__AEO01350
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagcacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68450 - RNA, 1701 nt, Artificial Sequence; identical to SEQ ID NO: 63677
  derived and/or modified sequence opt1 from hemagglutinin__InfluenzaA__AEO01351

SEQ ID NO: 68451 - RNA, 1701 nt, Artificial Sequence; identical to SEQ ID NO: 64841
  derived and/or modified sequence opt1 from hemagglutinin__InfluenzaA__AEO01352

SEQ ID NO: 68452 - RNA, 1701 nt, Artificial Sequence
  derived and/or modified sequence opt1 from hemagglutinin__InfluenzaA__AEO01353
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucuuccugggggccaucuccuucuggaugugcagcaacggcucccugcagugccggaucugcaucuga

SEQ ID NO: 68453 - RNA, 1701 nt, Artificial Sequence
  derived and/or modified sequence opt1 from hemagglutinin__InfluenzaA__AEO01354
augaaggccauccuggugguccuccuguacaaguucgccaccgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68454 - RNA, 1701 nt, Artificial Sequence; identical to SEQ ID NO: 65097
  derived and/or modified sequence opt1 from hemagglutinin__InfluenzaA__AEO01355

SEQ ID NO: 68455 - RNA, 1701 nt, Artificial Sequence; identical to SEQ ID NO: 63677
  derived and/or modified sequence opt1 from hemagglutinin__InfluenzaA__AEO01356

SEQ ID NO: 68456 - RNA, 1701 nt, Artificial Sequence
  derived and/or modified sequence opt1 from hemagglutinin__InfluenzaA__AEO01358
augaaggccauccuggugguccuccuguacaccuucgccaccgcgaacgccgacacgcugugcgugggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 68457 - RNA, 1701 nt, Artificial Sequence; identical to SEQ ID NO: 65097
  derived and/or modified sequence opt1 from hemagglutinin__InfluenzaA__AEO01359

SEQ ID NO: 68458 - RNA, 1701 nt, Artificial Sequence; identical to SEQ ID NO: 68430
  derived and/or modified sequence opt1 from hemagglutinin__InfluenzaA__AEO01360

SEQ ID NO: 68459 - RNA, 1701 nt, Artificial Sequence; identical to SEQ ID NO: 64030
  derived and/or modified sequence opt1 from hemagglutinin__InfluenzaA__AEO01361

SEQ ID NO: 68460 - RNA, 1701 nt, Artificial Sequence; identical to SEQ ID NO: 68430
  derived and/or modified sequence opt1 from hemagglutinin__InfluenzaA__AEO01362

SEQ ID NO: 68461 - RNA, 1701 nt, Artificial Sequence; identical to SEQ ID NO: 64841
  derived and/or modified sequence opt1 from hemagglutinin__InfluenzaA__AEO01363

SEQ ID NO: 68462 - RNA, 1701 nt, Artificial Sequence
  derived and/or modified sequence opt1 from hemagglutinin__InfluenzaA__AEO01365
augaaggccauccuggugguccuccuguacaccuucgccaccgcgaacgccgacacgcugugcaucggcuaccacgccaacaacagcaccgacaccguggacaccgugcucaagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcuccgccgggagcggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggcgaccggccuccgcaacgucccgagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 68463 - RNA, 1701 nt, Artificial Sequence
  derived and/or modified sequence opt1 from hemagglutinin__InfluenzaA__AEO01366
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcuccacgaccugccagaccccgaagggcgccaucaacaccagccugcccuuccagaacgugcaccccaucaccaucgggaagugccccaaguacgucaaguccaccaagcugcggcucgcgaccggccugcgcaacgugccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 68464 - RNA, 1701 nt, Artificial Sequence; identical to SEQ ID NO: 68435
  derived and/or modified sequence opt1 from hemagglutinin__InfluenzaA__AEO01367

SEQ ID NO: 68465 - RNA, 1701 nt, Artificial Sequence
  derived and/or modified sequence opt1 from hemagglutinin__InfluenzaA__AEO01368
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaacaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68466 - RNA, 1701 nt, Artificial Sequence; identical to SEQ ID NO: 63677
  derived and/or modified sequence opt1 from hemagglutinin__InfluenzaA__AEO01369

SEQ ID NO: 68467 - RNA, 1701 nt, Artificial Sequence; identical to SEQ ID NO: 68395
  derived and/or modified sequence opt1 from hemagglutinin__InfluenzaA__AEO01370

SEQ ID NO: 68468 - RNA, 1701 nt, Artificial Sequence; identical to SEQ ID NO: 68442
  derived and/or modified sequence opt1 from hemagglutinin__InfluenzaA__AEO01371

SEQ ID NO: 68469 - RNA, 1701 nt, Artificial Sequence; identical to SEQ ID NO: 65274
  derived and/or modified sequence opt1 from hemagglutinin__InfluenzaA__AEO01372

SEQ ID NO: 68470 - RNA, 1701 nt, Artificial Sequence; identical to SEQ ID NO: 65274
  derived and/or modified sequence opt1 from hemagglutinin__InfluenzaA__AEO01373

SEQ ID NO: 68471 - RNA, 1701 nt, Artificial Sequence
  derived and/or modified sequence opt1 from hemagglutinin__InfluenzaA__AEO01374
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacaucaagagcaccaagcugcggcucgcgaccggccugcgcaacgugccguccauccagagccgggggcuguucggcgccaucgccggguucaucgagggcggcuggacggggauggucgacggcugguacggguaccaccaccagaacgagcagggcuccggguacgccgccgaccucaagagcacccagcacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 68472 - RNA, 1701 nt, Artificial Sequence; identical to SEQ ID NO: 68446
  derived and/or modified sequence opt1 from hemagglutinin__InfluenzaA__AEO01375

SEQ ID NO: 68473 - RNA, 1701 nt, Artificial Sequence; identical to SEQ ID NO: 63677
  derived and/or modified sequence opt1 from hemagglutinin__InfluenzaA__AEO01376

SEQ ID NO: 68474 - RNA, 1701 nt, Artificial Sequence; identical to SEQ ID NO: 65845
  derived and/or modified sequence opt1 from hemagglutinin__InfluenzaA__AEO01377

SEQ ID NO: 68475 - RNA, 1701 nt, Artificial Sequence
  derived and/or modified sequence opt1 from hemagglutinin__InfluenzaA__AEO01378
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68476 - RNA, 1701 nt, Artificial Sequence; identical to SEQ ID NO: 64841
  derived and/or modified sequence opt1 from hemagglutinin__InfluenzaA__AEO01379

SEQ ID NO: 68477 - RNA, 1701 nt, Artificial Sequence; identical to SEQ ID NO: 68446
  derived and/or modified sequence opt1 from hemagglutinin__InfluenzaA__AEO01380

SEQ ID NO: 68478 - RNA, 1701 nt, Artificial Sequence; identical to SEQ ID NO: 68446
  derived and/or modified sequence opt1 from hemagglutinin__InfluenzaA__AEO01381

SEQ ID NO: 68479 - RNA, 1701 nt, Artificial Sequence; identical to SEQ ID NO: 64841
  derived and/or modified sequence opt1 from hemagglutinin__InfluenzaA__AEO01382

SEQ ID NO: 68480 - RNA, 1701 nt, Artificial Sequence; identical to SEQ ID NO: 65274
  derived and/or modified sequence opt1 from hemagglutinin__InfluenzaA__AEO01383

SEQ ID NO: 68481 - RNA, 1701 nt, Artificial Sequence
  derived and/or modified sequence opt1 from hemagglutinin__InfluenzaA__AEO01384
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucagcccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgcggccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 68482 - RNA, 1701 nt, Artificial Sequence
  derived and/or modified sequence opt1 from hemagglutinin__InfluenzaA__AEO01385
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccaacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 68483 - RNA, 1701 nt, Artificial Sequence; identical to SEQ ID NO: 68386
  derived and/or modified sequence opt1 from hemagglutinin__InfluenzaA__AEO01386

SEQ ID NO: 68484 - RNA, 1701 nt, Artificial Sequence
  derived and/or modified sequence opt1 from hemagglutinin__InfluenzaA__AEO01387
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacauccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 68485 - RNA, 1701 nt, Artificial Sequence
  derived and/or modified sequence opt1 from hemagglutinin__InfluenzaA__AEO01388
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68486 - RNA, 1701 nt, Artificial Sequence
  derived and/or modified sequence opt1 from hemagglutinin__InfluenzaA__AEO01389
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcaccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68487 - RNA, 1701 nt, Artificial Sequence
  derived and/or modified sequence opt1 from hemagglutinin__InfluenzaA__AEO01390
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucguggagaccucccgguacagcaagaaggucaagcccgagaucgccauccgcccgcgggugcgcgaccaggagggccggaugaacuacuacuggacgcugguggagcccggcgacaagaucaccuucgaggcgaccgggaaccucgucgugccccgcuacgccuucgccauggagcggaacgccggcuccgggaucaucaucagcgacacccccgugcacgacugcaacacgaccugccagaccccgaagggcgccaucaacaccucccugcccuuccagaacauccaccccaucacgaucggcaagugccccaaguacgucaagagcaccaagcugcgccucgcgaccgggcugcggaacgugccguccauccagagccgcggccuguucggggccaucgccggcuucaucgagggcggcuggaccggcaugguggacgggugguacggcuaccaccaccagaacgagcagggguccggcuacgccgccgaccucaagagcacgcagcacgcgaucgacgagaucaccaacaaggucaacuccgugaucgagaagaugaacacccaguucaccgccgucgggaaggaguucaaccaccuggagaagcggaucgagaaccugaacaagaagguggacgacggcuuccucgacaucuggacguacaacgccgagcugcuggugcuccuggagaacgagcgcacccuggacuaccacgacagcaacgucaagaaccucuacgagaaggugcggucccagcugaagaacaacgccaaggagaucggcaacgggugcuucgaguucuaccacaagugcgacaacacgugcauggagagcgugaagaacggcaccuacgacuaccccaaguacuccgaggucgccaagcugaaccgcgaggagaucaacggggugaagcucgagagcacccggaucuaccagauccuggcgaucuacuccaccguggccagcagccugguccucguggugucccugggcgccaucagcuucuggaugugcuccaacgggagccugcagugccgcaucugcaucuga

SEQ ID NO: 68488 - RNA, 1701 nt, Artificial Sequence; identical to SEQ ID NO: 68386
  derived and/or modified sequence opt1 from hemagglutinin__InfluenzaA__AEO01391

SEQ ID NO: 68489 - RNA, 1701 nt, Artificial Sequence; identical to SEQ ID NO: 68395
  derived and/or modified sequence opt1 from hemagglutinin__InfluenzaA__AEO01392

SEQ ID NO: 68490 - RNA, 1701 nt, Artificial Sequence; identical to SEQ ID NO: 65274
  derived and/or modified sequence opt1 from hemagglutinin__InfluenzaA__AEO01393

SEQ ID NO: 68491 - RNA, 1701 nt, Artificial Sequence; identical to SEQ ID NO: 64778
  derived and/or modified sequence opt1 from hemagglutinin__InfluenzaA__AEO01394

SEQ ID NO: 68492 - RNA, 1701 nt, Artificial Sequence
  derived and/or modified sequence opt1 from hemagglutinin__InfluenzaA__AEO01395
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuuccucgacuacgaggagcugcgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccucaucuggcuggugaagaaggggaacagcuaccccaagcuguccaagagcuacaucaacgacaagggcaaggaggugcucguccugugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccucguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 68493 - RNA, 1701 nt, Artificial Sequence; identical to SEQ ID NO: 64778
  derived and/or modified sequence opt1 from hemagglutinin__InfluenzaA__AEO01396

SEQ ID NO: 68494 - RNA, 1701 nt, Artificial Sequence
  derived and/or modified sequence opt1 from hemagglutinin__InfluenzaA__AEO01397
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacacggacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccugguggucccccgguacgcguucgccauggagcgcaacgccggguccggcaucaucaucagcgacacccccgugcacgacugcaacacgaccugccagaccccgaagggcgccaucaacaccucccuccccuuccagaacauccaccccaucaccaucgggaagugccccaaguacgucaagagcaccaagcugcggcuggccacgggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgccaucuacuccaccgucgcgagcagccuggugcugguggucucccucggggccaucagcuucuggaugugcuccaacggcagccugcagugccggaucugcaucuga

SEQ ID NO: 68495 - RNA, 1701 nt, Artificial Sequence
  derived and/or modified sequence opt1 from hemagglutinin__InfluenzaA__AEO01398
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccaacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 68496 - RNA, 1701 nt, Artificial Sequence; identical to SEQ ID NO: 68395
  derived and/or modified sequence opt1 from hemagglutinin__InfluenzaA__AEO01399

SEQ ID NO: 68497 - RNA, 1701 nt, Artificial Sequence; identical to SEQ ID NO: 63677
  derived and/or modified sequence opt1 from hemagglutinin__InfluenzaA__AEO01402

SEQ ID NO: 68498 - RNA, 1701 nt, Artificial Sequence; identical to SEQ ID NO: 64841
  derived and/or modified sequence opt1 from hemagglutinin__InfluenzaA__AEO01403

SEQ ID NO: 68499 - RNA, 1701 nt, Artificial Sequence; identical to SEQ ID NO: 63677
  derived and/or modified sequence opt1 from hemagglutinin__InfluenzaA__AEO01404

SEQ ID NO: 68500 - RNA, 1701 nt, Artificial Sequence
  derived and/or modified sequence opt1 from hemagglutinin__InfluenzaA__AEO01405
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcaccaugaucuaccagauccuggcgaucuacuccaccgucgccagcagccuggugcucguggucucccugggggccaucagcuucuggaugugcuccaacggcagccugcagugccgcaucugcaucuga

SEQ ID NO: 68501 - RNA, 1701 nt, Artificial Sequence
  derived and/or modified sequence opt1 from hemagglutinin__InfluenzaA__AEO01407
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucaacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68502 - RNA, 1701 nt, Artificial Sequence
  derived and/or modified sequence opt1 from hemagglutinin__InfluenzaA__AEO01408
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 68503 - RNA, 1701 nt, Artificial Sequence; identical to SEQ ID NO: 64779
  derived and/or modified sequence opt1 from hemagglutinin__InfluenzaA__AEO01409

SEQ ID NO: 68504 - RNA, 1701 nt, Artificial Sequence; identical to SEQ ID NO: 68395
  derived and/or modified sequence opt1 from hemagglutinin__InfluenzaA__AEO01410

SEQ ID NO: 68505 - RNA, 1701 nt, Artificial Sequence; identical to SEQ ID NO: 67096
  derived and/or modified sequence opt1 from hemagglutinin__InfluenzaA__AEO01411

SEQ ID NO: 68506 - RNA, 1701 nt, Artificial Sequence; identical to SEQ ID NO: 64030
  derived and/or modified sequence opt1 from hemagglutinin__InfluenzaA__AEO01412

SEQ ID NO: 68507 - RNA, 1701 nt, Artificial Sequence
  derived and/or modified sequence opt1 from hemagglutinin__InfluenzaA__AEO01413
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcucaagagcaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68508 - RNA, 1701 nt, Artificial Sequence
  derived and/or modified sequence opt1 from hemagglutinin__InfluenzaA__AEO01414
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacacgggguccggcaucaucaucagcgacacccccgugcacgacugcuccacgaccugccagaccccgaagggcgccaucaacaccagccugcccuuccagaacgugcaccccaucaccaucgggaagugccccaaguacgucaaguccaccaagcugcggcucgccacgggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggucaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcgagcucccuggugcucgucgugagccugggggccaucuccuucuggaugugcagcaacggcucccugcagugccggaucugcaucuga

SEQ ID NO: 68509 - RNA, 1701 nt, Artificial Sequence; identical to SEQ ID NO: 67308
  derived and/or modified sequence opt1 from hemagglutinin__InfluenzaA__AEO01416

SEQ ID NO: 68510 - RNA, 1701 nt, Artificial Sequence; identical to SEQ ID NO: 64841
  derived and/or modified sequence opt1 from hemagglutinin__InfluenzaA__AEO01418

SEQ ID NO: 68511 - RNA, 1701 nt, Artificial Sequence; identical to SEQ ID NO: 64841
  derived and/or modified sequence opt1 from hemagglutinin__InfluenzaA__AEO01419

SEQ ID NO: 68512 - RNA, 1701 nt, Artificial Sequence
  derived and/or modified sequence opt1 from hemagglutinin__InfluenzaA__AEO01420
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaguacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68513 - RNA, 1701 nt, Artificial Sequence
  derived and/or modified sequence opt1 from hemagglutinin__InfluenzaA__AEO01421
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68514 - RNA, 1701 nt, Artificial Sequence
  derived and/or modified sequence opt1 from hemagglutinin__InfluenzaA__AEO01422
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaaccuguaccccaagcugagcaaguccuacaucaacgacaagggcaaggaggugcucguccugugggggauccaccaccccagcaccagcgccgaccagcagucccuguaccagaacgccgacgccuacguguucgugggcaccagccgguacuccaagaaguucaagcccgagaucgccauccgcccgaagguccgggaccaggagggccgcaugaacuacuacuggacgcucguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcuccggcuggcgaccggccugcgcaacgucccgagcauccagucccggggccucuucggcgccaucgccggguucaucgagggcggcuggaccgggaugguggacggcugguacggguaccaccaccagaacgagcagggcagcggguacgccgccgaccugaaguccacgcagcacgcgaucgacgagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucaacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 68515 - RNA, 1701 nt, Artificial Sequence
  derived and/or modified sequence opt1 from hemagglutinin__InfluenzaA__AEO01423
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucaccauccgcccgaaggugcgggaccaggagggccgcaugaacuacuacuggacccuggucgagcccggggacaagaucaccuucgaggccacgggcaaccucguggugccccgguacgcguucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 68516 - RNA, 1701 nt, Artificial Sequence; identical to SEQ ID NO: 68513
  derived and/or modified sequence opt1 from hemagglutinin__InfluenzaA__AEO01424

SEQ ID NO: 68517 - RNA, 1701 nt, Artificial Sequence; identical to SEQ ID NO: 68513
  derived and/or modified sequence opt1 from hemagglutinin__InfluenzaA__AEO01425

SEQ ID NO: 68518 - RNA, 1701 nt, Artificial Sequence; identical to SEQ ID NO: 63677
  derived and/or modified sequence opt1 from hemagglutinin__InfluenzaA__AEO01426

SEQ ID NO: 68519 - RNA, 1701 nt, Artificial Sequence
  derived and/or modified sequence opt1 from hemagglutinin__InfluenzaA__AEO01427
augaaggccauccuggugguccuccuguacaccuucgccaccgcgaacagcgacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 68520 - RNA, 1701 nt, Artificial Sequence
  derived and/or modified sequence opt1 from hemagglutinin__InfluenzaA__AEO01428
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 68521 - RNA, 1701 nt, Artificial Sequence; identical to SEQ ID NO: 64841
  derived and/or modified sequence opt1 from hemagglutinin__InfluenzaA__AEO01429

SEQ ID NO: 68522 - RNA, 1701 nt, Artificial Sequence
  derived and/or modified sequence opt1 from hemagglutinin__InfluenzaA__AEO01430
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgacggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68523 - RNA, 1701 nt, Artificial Sequence; identical to SEQ ID NO: 68395
  derived and/or modified sequence opt1 from hemagglutinin__InfluenzaA__AEO01431

SEQ ID NO: 68524 - RNA, 1701 nt, Artificial Sequence; identical to SEQ ID NO: 63677
  derived and/or modified sequence opt1 from hemagglutinin__InfluenzaA__AEO01432

SEQ ID NO: 68525 - RNA, 1701 nt, Artificial Sequence
  derived and/or modified sequence opt1 from hemagglutinin__InfluenzaA__AEO01434
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucggggagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68526 - RNA, 1701 nt, Artificial Sequence
  derived and/or modified sequence opt1 from hemagglutinin__InfluenzaA__AEO01435
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccguguacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68527 - RNA, 1701 nt, Artificial Sequence; identical to SEQ ID NO: 68513
  derived and/or modified sequence opt1 from hemagglutinin__InfluenzaA__AEO01436

SEQ ID NO: 68528 - RNA, 1701 nt, Artificial Sequence; identical to SEQ ID NO: 68395
  derived and/or modified sequence opt1 from hemagglutinin__InfluenzaA__AEO01437

SEQ ID NO: 68529 - RNA, 1701 nt, Artificial Sequence; identical to SEQ ID NO: 68446
  derived and/or modified sequence opt1 from hemagglutinin__InfluenzaA__AEO01438

SEQ ID NO: 68530 - RNA, 1701 nt, Artificial Sequence; identical to SEQ ID NO: 64030
  derived and/or modified sequence opt1 from hemagglutinin__InfluenzaA__AEO01440

SEQ ID NO: 68531 - RNA, 1701 nt, Artificial Sequence
  derived and/or modified sequence opt1 from hemagglutinin__InfluenzaA__AEO01441
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgacggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68532 - RNA, 1701 nt, Artificial Sequence; identical to SEQ ID NO: 65097
  derived and/or modified sequence opt1 from hemagglutinin__InfluenzaA__AEO01442

SEQ ID NO: 68533 - RNA, 1701 nt, Artificial Sequence
  derived and/or modified sequence opt1 from hemagglutinin__InfluenzaA__AEO01443
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 68534 - RNA, 1701 nt, Artificial Sequence
  derived and/or modified sequence opt1 from hemagglutinin__InfluenzaA__AEO01444
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccgacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68535 - RNA, 1701 nt, Artificial Sequence; identical to SEQ ID NO: 65845
  derived and/or modified sequence opt1 from hemagglutinin__InfluenzaA__AEO01445

SEQ ID NO: 68536 - RNA, 1701 nt, Artificial Sequence; identical to SEQ ID NO: 68395
  derived and/or modified sequence opt1 from hemagglutinin__InfluenzaA__AEO01446

SEQ ID NO: 68537 - RNA, 1701 nt, Artificial Sequence
  derived and/or modified sequence opt1 from hemagglutinin__InfluenzaA__AEO01447
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccaucgccagcagccugguccucguggugucccugggggccaucagcuucuggaugugcuccaacggcagccugcagugccggaucugcaucuga

SEQ ID NO: 68538 - RNA, 1701 nt, Artificial Sequence; identical to SEQ ID NO: 64030
  derived and/or modified sequence opt1 from hemagglutinin__InfluenzaA__AEO01448

SEQ ID NO: 68539 - RNA, 1701 nt, Artificial Sequence; identical to SEQ ID NO: 68513
  derived and/or modified sequence opt1 from hemagglutinin__InfluenzaA__AEO01449

SEQ ID NO: 68540 - RNA, 1701 nt, Artificial Sequence
  derived and/or modified sequence opt1 from hemagglutinin__InfluenzaA__AEO01450
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccacggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagcacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68541 - RNA, 1701 nt, Artificial Sequence; identical to SEQ ID NO: 63677
  derived and/or modified sequence opt1 from hemagglutinin__InfluenzaA__AEO01451

SEQ ID NO: 68542 - RNA, 1701 nt, Artificial Sequence
  derived and/or modified sequence opt1 from hemagglutinin__InfluenzaA__AEO01452
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccgaggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgcccacgacugcaacacgaccugccagaccccgaagggcgcgaucaacaccucccugcccuuccagaacauccaccccaucaccaucggcaagugccccaaguacgucaagagcaccaagcugcggcucgccaccgggcugcgcaacgugccguccauccagagccggggccuguucggggccaucgccggcuucaucgagggcggguggacgggcaugguggacgggugguacggcuaccaccaccagaacgagcagggguccggcuacgccgcggaccucaagagcacccagaacgccaucgacgagaucaccaacaaggugaacuccgugaucgagaagaugaacacccaguucacggccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaagcucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggcgaagcugaaccgggaggagaucgacggggugaagcucgagagcacccgcaucuaccagauccuggccaucuacuccaccguggccagcagccugguccucguggugucccugggcgccaucagcuucuggaugugcuccaacgggagccugcagugccggaucugcaucuga

SEQ ID NO: 68543 - RNA, 1701 nt, Artificial Sequence
  derived and/or modified sequence opt1 from hemagglutinin__InfluenzaA__AEO01453
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucuggggcgugcaccaccccagcaccuccgccgaccagcagagccuguaccagaacgccgacgccuacguguucgucggcaccucccgguacagcaagaaguucaagcgcgagaucgccauccggcccaaggugcgcgaccaggagggccggaugaacuacuacuggacgcugguggagccgggggacaagaucaccuucgaggcgaccggcaaccucgucgugccccgcuacgccuucgccauggagcggaacgccggguccggcaucaucaucagcgacacccccgugcacgacugcaacacgaccugccagacccccaagggcgccaucaacaccucccugccguuccagaacauccaccccaucacgaucgggaagugccccaaguacgucaagagcaccaagcugcgccucgcgaccggccugcggaacgugcccuccauccagagccgcgggcuguucggcgccaucgccggguucaucgagggcggcuggaccgggaugguggacggcugguacggguaccaccaccagaacgagcagggcuccggguacgccgccgaccucaagagcacgcagcacgcgaucgacgagaucaccaacaaggucaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgcgaggagaucaacggcgucaagcucgagagcacccggaucuaccagauccuggcgaucuacuccaccguggccagcagccuggugcucgucgugucccugggggccaucagcuucuggaugugcuccaacggcagccugcagugccgcaucugcaucuga

SEQ ID NO: 68544 - RNA, 1701 nt, Artificial Sequence
  derived and/or modified sequence opt1 from hemagglutinin__InfluenzaA__AEO01454
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaccaccaucgggaagugccccaaguacgucaagagcaccaagcugcggcuggcgacgggccuccgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 68545 - RNA, 1701 nt, Artificial Sequence
  derived and/or modified sequence opt1 from hemagglutinin__InfluenzaA__AEO01455
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 68546 - RNA, 1701 nt, Artificial Sequence
  derived and/or modified sequence opt1 from hemagglutinin__InfluenzaA__AEO01456
augaaggccauccugaucgugcuccuguacaccuucgccaccgcgaacgccgacacgcugugcaucggcuaccacgccaacaacagcaccgacaccgucgacacccuccuggagaagaacgugacggugacccacuccgucaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucguggagaccuccagcuccgacaacggcacgugcuaccccggcgacuucaucgacuacgaggagcugcgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccucaucuggcuggugaagaaggggaacagcuaccccaagcuguccaagagcuacaucaacgacaagggcaaggagguccucgugcugugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucgccauggaccgcaacgccggguccggcaucaucaucagcgacgcccccgugcacgacugcaacacgaccugccagaccccgaagggcgcgaucaacaccucccugcccuuccagaacauccaccccaucacgaucgggaagugccccaaguacgucaagagcaccaagcuccggcuggccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggucaacuccgugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgggaggagaucgacggcgucaagcuggagagcacccgcaucuaccagauccuggccaucuacuccaccguggccagcagccucgugcuggucgugucccugggggccaucagcuucuggaugugcuccaacggcagccuccagugccggaucugcaucuga

SEQ ID NO: 68547 - RNA, 1701 nt, Artificial Sequence; identical to SEQ ID NO: 68446
  derived and/or modified sequence opt1 from hemagglutinin__InfluenzaA__AEO01457

SEQ ID NO: 68548 - RNA, 1701 nt, Artificial Sequence; identical to SEQ ID NO: 68442
  derived and/or modified sequence opt1 from hemagglutinin__InfluenzaA__AEO01458

SEQ ID NO: 68549 - RNA, 1701 nt, Artificial Sequence; identical to SEQ ID NO: 68442
  derived and/or modified sequence opt1 from hemagglutinin__InfluenzaA__AEO01459

SEQ ID NO: 68550 - RNA, 1701 nt, Artificial Sequence; identical to SEQ ID NO: 65097
  derived and/or modified sequence opt1 from hemagglutinin__InfluenzaA__AEO01461

SEQ ID NO: 68551 - RNA, 1701 nt, Artificial Sequence; identical to SEQ ID NO: 64778
  derived and/or modified sequence opt1 from hemagglutinin__InfluenzaA__AEO01462

SEQ ID NO: 68552 - RNA, 1701 nt, Artificial Sequence; identical to SEQ ID NO: 64030
  derived and/or modified sequence opt1 from hemagglutinin__InfluenzaA__AEO01463

SEQ ID NO: 68553 - RNA, 1701 nt, Artificial Sequence
  derived and/or modified sequence opt1 from hemagglutinin__InfluenzaA__AEO01464
augaaggccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccucgucgagcccggggacaagaucaccuucgaggcgaccggcaaccugguggugccccgguacgccuucgccauggaccgcaacgccggguccggcaucaucaucagcgacacguccguccacgacugcaacacgaccugccagacccccaagggcgccaucaacaccagccugccguuccagaacauccaccccaucaccaucgggaagugccccaaguacgugaaguccaccaagcuccggcuggcgaccggccugcgcaacgugcccagcauccagucccggggccucuucggggccaucgccggguucaucgagggcggcuggacggggauggucgacggcugguacggguaccaccaccagaacgagcagggcagcggguacgccgccgaccugaaguccacccagaacgcgaucgacgagaucaccaacaaggugaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuacccgaaguacagcgaggaggccaagcucaaccgggaggagaucgacggcgugaagcuggaguccacccgcaucuaccagauccuggcgaucuacagcaccguggccagcucccucguccugguggugagccugggggccaucuccuucuggaugugcagcaacggcucccuccagugccggaucugcaucuga

SEQ ID NO: 68554 - RNA, 1701 nt, Artificial Sequence; identical to SEQ ID NO: 68533
  derived and/or modified sequence opt1 from hemagglutinin__InfluenzaA__AEO01465

SEQ ID NO: 68555 - RNA, 1701 nt, Artificial Sequence; identical to SEQ ID NO: 65549
  derived and/or modified sequence opt1 from hemagglutinin__InfluenzaA__AEO01466

SEQ ID NO: 68556 - RNA, 1701 nt, Artificial Sequence; identical to SEQ ID NO: 64030
  derived and/or modified sequence opt1 from hemagglutinin__InfluenzaA__AEO01467

SEQ ID NO: 68557 - RNA, 1701 nt, Artificial Sequence; identical to SEQ ID NO: 64841
  derived and/or modified sequence opt1 from hemagglutinin__InfluenzaA__AEO01468

SEQ ID NO: 68558 - RNA, 1701 nt, Artificial Sequence; identical to SEQ ID NO: 63677
  derived and/or modified sequence opt1 from hemagglutinin__InfluenzaA__AEO01469

SEQ ID NO: 68559 - RNA, 1701 nt, Artificial Sequence
  derived and/or modified sequence opt1 from hemagglutinin__InfluenzaA__AEO01470
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucgugaucccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 68560 - RNA, 1701 nt, Artificial Sequence; identical to SEQ ID NO: 68386
  derived and/or modified sequence opt1 from hemagglutinin__InfluenzaA__AEO01471

SEQ ID NO: 68561 - RNA, 1701 nt, Artificial Sequence; identical to SEQ ID NO: 65304
  derived and/or modified sequence opt1 from hemagglutinin__InfluenzaA__AEO01472
